US012788828B2

(12) United States Patent
Perez-Garcia et al.

(10) Patent No.: US 12,788,828 B2

(45) **Date of Patent: *Nov. 10, 2026**

(54) NUCLEIC ACIDS AND METHODS OF TREATMENT FOR CYSTIC FIBROSIS

(71) Applicant: ARCTURUS THERAPEUTICS, INC., San Diego, CA (US)

(72) Inventors: Carlos G. Perez-Garcia, San Diego, CA (US); Kiyoshi Tachikawa, San Diego, CA (US); Daiki Matsuda, San Diego, CA (US); Padmanabh Chivukula, San Diego, CA (US); Priya Prakash Karmali, San Diego, CA (US); Yanjie Bao, San Diego, CA (US); Jerel Boyd Lee Vega, San Diego, CA (US); Rajesh Mukthavaram, San Diego, CA (US); Amit Sagi, San Diego, CA (US)

(73) Assignee: ARCTURUS THERAPEUTICS, INC., San Diego, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/732,954

(22) Filed: Jun. 4, 2024

(65) Prior Publication Data

US 2025/0049950 A1 Feb. 13, 2025

Related U.S. Application Data

(63) Continuation of application No. 17/246,558, filed on Apr. 30, 2021, now Pat. No. 12,070,509.

(60) Provisional application No. 63/082,997, filed on Sep. 24, 2020, provisional application No. 63/019,170, filed on May 1, 2020.

(51) Int. Cl.

| | |
|---|---|
| ***A61P 11/00*** | (2006.01) |
| ***A61K 48/00*** | (2006.01) |
| ***C07K 14/47*** | (2006.01) |

(52) U.S. Cl.

CPC ........ *A61K 48/0033* (2013.01); *A61K 48/005* (2013.01); *A61P 11/00* (2018.01); *C07K 14/4702* (2013.01)

(58) Field of Classification Search

CPC ............................ A61K 48/0033; A61P 11/00

See application file for complete search history.

(56) References Cited

U.S. PATENT DOCUMENTS

| | | | |
|---|---|---|---|
| 4,511,069 A | 4/1985 | Kalat | |
| 4,778,810 A | 10/1988 | Wenig et al. | |
| 5,780,014 A | 7/1998 | Eljamal et al. | |
| 8,093,367 B2 | 1/2012 | Kore et al. | |
| 8,158,601 B2 | 4/2012 | Chen et al. | |
| 8,304,529 B2 | 11/2012 | Kore et al. | |
| 8,999,380 B2 | 4/2015 | Bancel et al. | |
| 9,181,321 B2 * | 11/2015 | Heartlein | A61K 9/0078 |
| 9,220,792 B2 * | 12/2015 | Chakraborty | C12N 9/2402 |
| 9,593,077 B2 * | 3/2017 | Payne | A61K 47/18 |
| 9,713,626 B2 | 7/2017 | Heartlein et al. | |
| 10,487,105 B2 | 11/2019 | Chivukula et al. | |
| 12,070,509 B2 * | 8/2024 | Perez-Garcia | A61K 48/005 |
| 2011/0256175 A1 | 10/2011 | Hope et al. | |
| 2012/0027803 A1 | 2/2012 | Manoharan et al. | |
| 2012/0128760 A1 | 5/2012 | Manoharan et al. | |
| 2015/0038556 A1 | 2/2015 | Heartlein et al. | |
| 2018/0051262 A1 * | 2/2018 | Chivukula | A61P 35/00 |
| 2018/0256741 A1 * | 9/2018 | Dias | A61K 31/7105 |
| 2018/0273576 A1 | 9/2018 | Hogrefe et al. | |
| 2018/0327471 A1 | 11/2018 | Limphong et al. | |
| 2018/0333457 A1 | 11/2018 | Heartlein et al. | |
| 2019/0002906 A1 | 1/2019 | Limphong et al. | |
| 2020/0085745 A1 | 3/2020 | Karve et al. | |
| 2021/0317468 A1 | 10/2021 | Limphong et al. | |
| 2022/0023442 A1 | 1/2022 | Perez-garcia et al. | |
| 2023/0159449 A1 * | 5/2023 | Perez-Garcia | A61K 9/5123 558/232 |

FOREIGN PATENT DOCUMENTS

| | | | |
|---|---|---|---|
| CA | 3171219 | A1 | 9/2021 |
| KR | 20040051450 | A | 6/2004 |
| WO | 9207065 | A1 | 4/1992 |
| WO | 9315187 | A1 | 8/1993 |
| WO | WO 2008/080816 | A1 | 7/2008 |
| WO | 2009086558 | A1 | 7/2009 |
| WO | 2009127060 | A1 | 10/2009 |
| WO | 2010048536 | A2 | 4/2010 |
| WO | 2010054406 | A1 | 5/2010 |
| WO | 2010088537 | A2 | 8/2010 |
| WO | 2010129709 | A1 | 11/2010 |
| WO | 2011153493 | A2 | 12/2011 |

(Continued)

OTHER PUBLICATIONS (1978) "Federation of Experimental Biologists Society Letter", 96:1-11.

Altschul et al., (Oct. 5, 1990) "Basic Local Alignment Search Tool", Journal of Molecular Biology, 215(3):403-410.

Andries et al., (Jun. 25, 2012) "Comparison of the Gene Transfer Efficiency of mRNA/GL67 and pDNA/GL67 Complexes in Respiratory Cells". Molecular Pharmaceutics, 9(8):2136-2145.

Berge et al., (Jan. 1977) "Pharmaceutical Salts", Journal of Pharmaceutical Sciences, 66(1):1-19.

(Continued)

*Primary Examiner* — James D Schultz

*Assistant Examiner* — Keenan A Bates

(74) *Attorney, Agent, or Firm* — Greenberg Traurig LLP

(57) ABSTRACT

Nucleotides encoding a Cystic Fibrosis Transmembrane Conductance Regulator (CFTR) protein are provided herein. Also describe are mRNA constructs that can be used to express CFTR protein in vitro or in vivo. The mRNA constructs can be formulated in a lipid formulation and administered via inhalation to treat cystic fibrosis.

22 Claims, 49 Drawing Sheets

Specification includes a Sequence Listing.

(56) References Cited

FOREIGN PATENT DOCUMENTS

| | | | | | |
|---|---|---|---|---|---|
| WO | 2013151666 | A2 | | 10/2013 | |
| WO | 2015051169 | A2 | | 4/2015 | |
| WO | 2015061491 | A1 | | 4/2015 | |
| WO | WO 2015/074085 | A1 | | 5/2015 | |
| WO | 2016070166 | A2 | | 5/2016 | |
| WO | WO 2018/119163 | A1 | | 6/2018 | |
| WO | 2018157154 | A2 | | 8/2018 | |
| WO | WO-2018222890 | A1 | * | 12/2018 | ............. C07K 14/75 |
| WO | WO 2019/191780 | A1 | | 10/2019 | |
| WO | 2021222801 | A2 | | 11/2021 | |

OTHER PUBLICATIONS

Bochicchio et al., (2014) "Liposomes as siRNA Delivery Vectors", Current Drug Metabolism. 15(9):882-892.

Both et al., (Mar. 1, 1975) "Methylation-Dependent Translation Of Viral Messenger RNAs In Vitro", Proceedings of the National Academy of Sciences, 72(3):1189-1193.

Bouloy et al., (Jul. 1, 1980) "Both The 7-Methyl and The 2'-O-Methyl Groups In The Cap Of mRNA Strongly Influence Its Ability To Act As Primer For Influenza Virus RNA Transcription", Proceedings of the National Academy of Sciences, 77(7):3952-3956.

Brown et al., (Apr. 10, 2013) "Thoracic and Respirable Particle Definitions for Human Health Risk Assessment", Particle and Fibre Toxicology, 10:12 Pages.

Burgin et al., (Nov. 12, 1996) "Chemically Modified Hammerhead Ribozymes with Improved Catalytic Rates", Biochemistry, 35(45):14090-14097.

Carrillo et al., (Oct. 1988) "The Multiple Sequence Alignment Problem in Biology", SIAM Journal on Applied Mathematics, 48(5):1073-1082.

Chang et al., (Sep. 1, 2008) "Role of N-linked Oligosaccharides in the Biosynthetic Processing of the Cystic Fibrosis Membrane Conductance Regulator", Journal of Cell Science, 121(Pt 17):2814-2823 (23 Pages).

Chow et al., (Dec. 23, 1997) "Development of an Epithelium-specific Expression Cassette with Human DNA Regulatory Elements for Transgene Expression in Lung Airways", Proceedings of the National Academy of Sciences of the United States of America, 94(26):14695-14700.

Chu et al., (Aug. 1978) "Paradoxical Observations on the 5' Terminus of Ovalbumin Messenger Ribonucleic Acid". Journal of Biological Chemistry, 253(15):5228-5231.

Dabkowska et al., (Mar. 7, 2012) "The Effect of Neutral Helper Lipids on the Structure of Cationic Lipid Monolayers", Journal of the Royal Society Interface, 9(68):548-561.

Devereux et al., (Jan. 11, 1984) "A Comprehensive Set of Sequence Analysis Programs for the VAX", Nucleic Acids Research, 12(1):387-395.

Dua et al., (2012) "Liposome: Methods of Preparation and Applications", International Journal of Pharmaceutical Studies and Research, 3(3):14-20.

Furuichi et al., (Mar. 1, 1977) "5'-Terminal Structure and mRNA Stability", Nature, 266:235-239.

Galili et al., (1988) "Role of the 3'-poly(a) Sequence in Translational Regulation of Mrnas in Xenopus Laevis Oocytes", The Journal of Biological Chemistry, 263(12):5764-70.

Gingras et al., (1999) "elF4 Initiation Factors: Effectors Of mRNA Recruitment To Ribosomes And Regulators Of Translation", Annual Review of Biochemistry, 68:913-963.

Gustafsson et al., (Jul. 2004) "Codon Bias and Heterologous Protein Expression", Trends in Biotechnology, 22(7):346-353.

Hodges et al., (Oct. 2008) "Generation of a Conditional Null Allele for Cftr in Mice", Genesis, 46(10):546-552.

Huang et al., (Aug. 15, 2011) "In Vivo Delivery of RNAi with Lipid-Based Nanoparticles", Annual Review of Biomedical Engineering, 13:507-530.

Ishikawa et al., (Sep. 27, 2009) "Preparation of Eukaryotic mRNA having Differently Methylated Adenosine at the 5'-Terminus and the Effect of the Methyl Group in Translation", Nucleic Acids Symposium, 53(1):129-130.

Jokerst et al., (Jun. 2011) "Nanoparticle PEGylation for Imaging and Therapy", Nanomedicine (Lond), 6(4):715-728.

Kawabata et al., (1995) "The Fate of Plasmid DNA After Intravenous Injection in Mice: Involvement of Scavenger Receptors in Its Hepatic Uptake", Pharmaceutical Research, 12:825-830.

Kozak, (Jan. 31, 1986) "Point Mutations Define a Sequence Flanking the AUG Initiator Codon that Modulates Translation by Eukaryotic Ribosomes", Cell, 44(2):283-292.

Kozak Marilyn, (Nov. 1990) "Downstream Secondary Structure Facilitates Recognition of Initiator Codons by Eukaryotic Ribosomes", Proceedings of the National Academy of Sciences, 87(21):8301-8305.

Kozak Marilyn, (Jul. 1988) "Leader Length and Secondary Structure Modulate mRNA Function Under Conditions Of Stress", Molecular and Cellular Biology, 8(7):2737-2744.

Kozak Marilyn, (Oct. 25, 1991) "Structural Features in Eukaryotic mRNAs That Modulate the Initiation of Translation", Journal of Biological Chemistry, 266(30):19867-19870.

Kozak Marilyn, (Feb. 1989) "The Scanning Model for Translation: An Update", Journal of Cell Biology, 108(2):229-241.

Kulkarni et al., (Jun. 2018) "Lipid Nanoparticles Enabling Gene Therapies: From Concepts to Clinical Utility", Nucleic Acid Therapeutics, 28(3):146-157.

Lasic Dand., (Jul. 1, 1998) "Novel Applications of Liposomes", Trends in Biotechnology. 16(7):307-321.

Li et al., (Jan. 2011) "Biosynthesis of Nanoparticles by Microorganisms and Their Applications", Journal of Nanomaterials, Article ID 270974, 2011:17 Pages.

Li et al., (Aug. 3, 2010) "Stealth Nanoparticles: High Density but Sheddable PEG is a Key for Tumor Targeting", Journal of Controlled Release, 145(3):178-181.

Li et al., (Aug. 1, 2004) "Transepithelial Electrical Measurements with the Ussing Chamber", Journal of Cystic Fibrosis, 3(Suppl 2):123-126.

Limbach et al., (Jun. 25, 1994) "Summary: The Modified Nucleosides of RNA", Nucleic Acids Research, 22(12):2183-2196.

Love et al., (Feb. 2, 2010) "Lipid-Like Materials for Low-Dose, in Vivo Gene Silencing", Proceedings of the National Academy of Sciences, 107(5):1864-1869.

Muthukrishnan et al., (May 1, 1975) "5'-Terminal 7-Methylguanosine in Eukaryotic mRNA is Required for Translation", Nature, 255:33-37.

Myers et al., (Mar. 1988) "Optimal Alignments in Linear Space", Computer Applications in the Biosciences., 4(1):11-17.

Patil et al., (Jan. 2014) "Novel Methods for Liposome Preparation", Chemistry and Physics of Lipids, 177:8-18.

Rhoads R.E., (Oct. 22, 1999) "Signal Transduction Pathways that Regulate Eukaryotic Protein Synthesis", Journal of Biological Chemistry, 274(43):30337-30340.

Rodriguez-Gascon et al., (Apr. 10, 2014) "Development of Nucleic Acid Vaccines: Use of Self-Amplifying RNA in Lipid Nanoparticles", International Journal of Nanomedicine, 9:1833-1843.

Schultz et al., (Jan. 1, 1999) "Pharmacology of CFTR Chloride Channel Activity", Physiological Reviews, 79:S109-S144.

Sercombe et al., (Dec. 1, 2015) "Advances and Challenges of Liposome Assisted Drug Delivery", Frontiers in Pharmacology. 6(286):13 Pages.

Shatkin A.J., (Feb. 1985) "mRNA Cap Binding Proteins: Essential Factors for Initiating Translation", Cell, 40(2):223-224.

Shatkin A. J., (Dec. 1976) "Capping of Eucaryotic mRNAs", Cell, 9(4 PT 2):645-653.

Sonenberg Nahum, (1988) "Cap-Binding Proteins of Eukaryotic Messenger RNA: Functions in Initiation and Control of Translation", Progress in Nucleic Acid Research and Molecular Biology. 35:173-207.

Svitkin et al., (2017) "N1-methyl-pseudouridine in Mrna Enhances Translation Through Eif2α-dependent and Independent Mechanisms by Increasing Ribosome Density", Nucleic Acids Research, 45(10):6023-6036.

(56) References Cited

OTHER PUBLICATIONS

Taverniti et al., (Jan. 9, 2015) "Elimination of Cap Structures Generated by mRNA Decay Involves the New Scavenger mRNA Decapping Enzyme Aph1/FHIT Together with DcpS", Nucleic Acids Research, 43(1):482-492.
Villalobos et al., (Jun. 6, 2006) "Gene Designer: A Synthetic Biology Tool for Constructing Artificial DNA Segments", BMC Bioinformatics, 7:285 (8 pages).
Extended European Search Report Issued in European Patent Application No. 21795851.1, mailed on Aug. 30, 2024, 10 Pages.
International Search Report and Written Opinion Issued in PCT Application No. PCT/US2021/030257, mailed on Oct. 21, 2021, 11 pages.
Invitation to Pay Additional Fees Issued in PCT Application No. PCT/US2021/030257, mailed on Aug. 11, 2021, 2 pages.
Lin et al., "Lipid-based Nanoparticles in the Systemic Delivery of siRNA," Nanomedicine, 9(1):105-120 (2014).

* cited by examiner

Donor 1

Donor 2

PBS

Lipid Formulated-eGFP

LF-1 (eGFP)

LF-2 (eGFP)

LF-3 (eGFP)

LF-1 (eGFP)

LF-2 (eGFP)

NUCLEIC ACIDS AND METHODS OF TREATMENT FOR CYSTIC FIBROSIS

CROSS-REFERENCES TO RELATED APPLICATIONS

This application is a continuation of U.S. application Ser. No. 17/246,558, filed Apr. 30, 2021, which claims the benefit of U.S. Provisional Application No. 63/019,170, filed May 1, 2020, and U.S. Provisional Application No. 63/082,997, filed Sep. 24, 2020, which are incorporated herein by reference in their entireties.

REFERENCE TO A SEQUENCE LISTING

The instant application contains a Sequence Listing which has been submitted electronically in XML format and is hereby incorporated by reference in its entirety. Said XML copy, created on Jun. 4, 2024 is named 049386-528C01US_SL_ST26.xml and is 659,456 bytes in size.

TECHNICAL FIELD

The present disclosure relates to mRNA sequences, compositions, and methods for the treatment of cystic fibrosis. More specifically, disclosed herein are mRNA sequences for expressing a Cystic Fibrosis Transmembrane Conductance Regulator (CFTR) protein or a fragment thereof in a lung of a subject.

BACKGROUND

Cystic fibrosis (CF) is an autosomal inherited disorder resulting from mutation of the CFTR gene, which encodes a chloride ion channel believed to be involved in regulation of several other ion channels and transport systems in epithelial cells. The CFTR protein helps to maintain the balance of salt and water on many surfaces in the body, such as the surface of the lung. When the protein is not expressed properly or not working correctly, chloride becomes trapped in cells. Without the proper movement of chloride, water cannot hydrate the cellular surface. The mucus covering the cells then becomes thick and sticky, causing many of the symptoms associated with cystic fibrosis. When the CFTR gene has detrimental mutations, the corresponding loss of function of the CFTR gene results in chronic lung disease, aberrant mucus production, and dramatically reduced life expectancy.

Currently, there is no cure for CF, but there are several therapies aimed at alleviating the adverse effects of CF, and the management of CF has improved significantly over the years. Seventy years ago, infants born with CF were unlikely to live beyond their first year, but today they can live well into adulthood. The current standard of care for CF patients includes proactive treatment of airway infection and inflammation with the aim of maximizing organ function and improving quality of life for patients. However, the best possible outcome with currently available treatments is a delay in the decline of organ function.

Several gene therapies have been proposed as a means to treat CF, however each of these is associated with undesirable effects or significant challenges. For example, despite the successful cloning of the CFTR gene in 1989, there have been numerous difficulties encountered in attempting to induce expression of CFTR in the lung. Some of these previous attempts have included viral vectors comprising CFTR DNA, which induced an immune response, and CF symptoms persisted after administration of the viral vector.

One potential therapy involves the delivery of mRNA encoding a CFTR protein to the lung epithelium of a CF patient. However, mRNA-based therapies face several obstacles including achieving an adequate in vivo half-life of the mRNA, achieving an adequate translation efficiency of the mRNA such that an effective amount of enzyme is produced, minimizing adverse reactions to the mRNA (e.g., immunogenicity), and effectively delivering the mRNA to a target cell type. Another difficulty in inducing CFTR expression in the lung of a subject pertains to the lung environment. Lung-specific difficulties have been reported for mRNA delivery using certain lipoplex formulations. For example, a comparison of in vitro and in vivo performance of lipoplexes carrying mRNA or DNA revealed that even though the mRNA composition gave higher expression in cultured cells, measurable expression was detected only with the DNA composition when administered intranasally to a mouse lung (Andries et al., Mol. Pharmaceut. 9, 2136-45, 2012).

Moreover, CFTR is a large gene when compared to model or reporter genes such as firefly luciferase (FFL), which are commonly used for proof of concept studies in mRNA-based therapies. In studies on the effect of coding sequence length that compared wild-type CFTR and FFL, it was determined that the difference in length can impact stability and whether and how much protein expression any given dose of mRNA will produce. Furthermore, the production of large mRNAs for therapy can be challenging. Generally, in vitro synthesis of mRNA is preferred to cellular synthesis due to the absence of normal cellular mRNA and other cellular components that constitute undesirable contaminants. However, in vitro synthesis of mRNA with a long coding sequence, such as CFTR mRNA, is substantially more difficult to achieve than in vitro synthesis of mRNA with a relatively short coding sequence as longer sequences provide more opportunities for transcription errors and the formation of undesirable by-products.

Another challenge associated with mRNA-based therapies is associated with the effective, specific, and non-toxic delivery of the mRNA to a target cell. One method for delivering nucleic acids to target cells that has been successfully employed is the encapsulation of the nucleic acid in a lipid formulation such as a liposome or a lipid nanoparticle. While the use of lipid formulations has had some success, it has been found that several of the lipids used in these formulations show low in vivo degradability, low potency, and the potential to cause adverse reactions.

In the light of challenges highlighted above, there remains a need for improved drug product, formulations, production methods, and delivery methods of CFTR mRNA for induction of CFTR expression in the treatment of CF.

SUMMARY

Additional features and advantages of the subject technology will be set forth in the description below, and in part will be apparent from the description, or may be learned by practice of the subject technology. It is to be understood that both the foregoing general description and the following detailed description are exemplary and explanatory and are intended to provide further explanation of the subject technology.

In one aspect, disclosed herein is an mRNA encoding a Cystic Fibrosis Transmembrane Conductance Regulator (CFTR) protein, or a fragment thereof, wherein the mRNA comprises an open reading frame (ORF) having about 80% sequence identity with SEQ ID NOs: 2, 3, 5, 7, 20, 22, 23, 26, 100, 101, 102, 103, 104, or 105.

In another aspect, disclosed herein is a pharmaceutical composition comprising an mRNA as disclosed herein, and a lipid of Formula I as described herein.

In another aspect, disclosed herein is a pharmaceutical composition comprising one or more mRNA sequences as disclosed herein, or a pharmaceutical composition and a pharmaceutically acceptable carrier.

In another aspect, disclosed herein is a pharmaceutical composition, for use in medical therapy. In another aspect, disclosed herein is a pharmaceutical composition, for use in the treatment of the human or animal body.

In another aspect, disclosed herein is a method for ameliorating, preventing, delaying onset, or treating a disease or disorder associated with reduced activity of Cystic Fibrosis Transmembrane Conductance Regulator (CFTR) in a subject need thereof, the method comprising administering to the subject a pharmaceutical composition as disclosed herein.

In another aspect, disclosed herein is a method of expressing a CFTR in a cell comprising contacting the cell with one or more mRNA sequences as disclosed herein or a pharmaceutical composition as disclosed herein.

In yet another aspect, disclosed herein is a kit for expressing a human CFTR in vivo, the kit comprising a 0.1 to 500 mg dose of one or more mRNA sequences as disclosed herein or a pharmaceutical composition as disclosed herein and a device for administering the dose.

BRIEF DESCRIPTION OF THE DRAWINGS

Various features of illustrative embodiments of the disclosures are described below with reference to the drawings. The illustrated embodiments are intended to illustrate, but not to limit, the disclosures.

FIGS. 42A-42C show animals treated with CRE mRNA-lipid formulation showed clear delivery of CRE mRNA to epithelial cells, as indicated by eGFP expression (bright staining surrounding the airway). By contrast, untreated controls showed only TdTomato expression due to a lack of CRE recombination (FIG. 42D).

DETAILED DESCRIPTION

Figure 1:
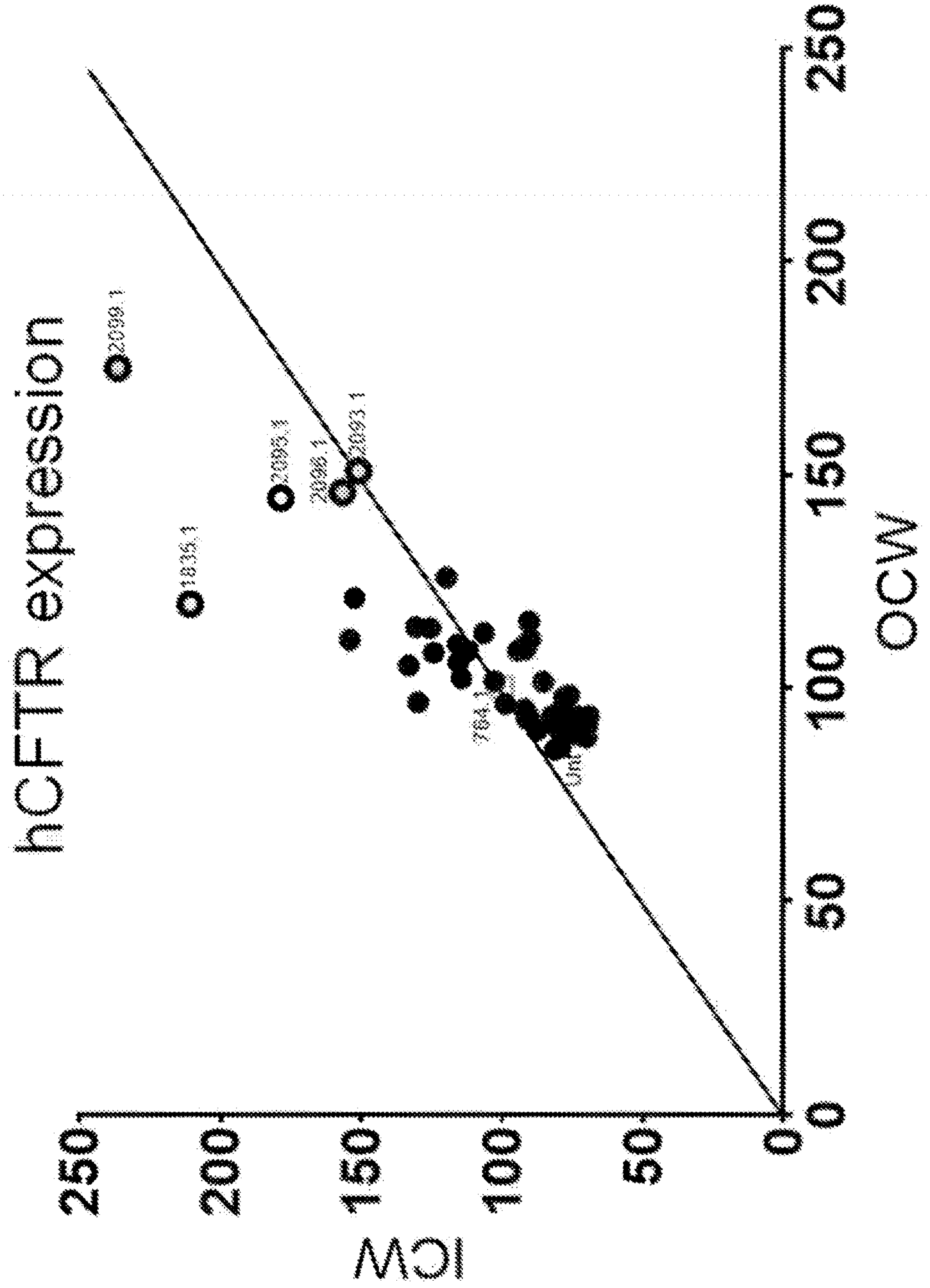
FIG. 1 shows the correlation of hCFTR protein expression levels for various hCFTR constructs determined by In-Cell Western (ICW) and On-Cell Western (OCW) using a human CFTR antibody for codon-optimized sequences as described in Example 3.

It is understood that various configurations of the subject technology will become readily apparent to those skilled in the art from the disclosure, wherein various configurations of the subject technology are shown and described by way of illustration. As will be realized, the subject technology is capable of other and different configurations and its several details are capable of modification in various other respects, all without departing from the scope of the subject technology. Accordingly, the summary, drawings and detailed description are to be regarded as illustrative in nature and not as restrictive.

The detailed description set forth below is intended as a description of various configurations of the subject technology and is not intended to represent the only configurations in which the subject technology may be practiced. The appended drawings are incorporated herein and constitute a part of the detailed description. The detailed description includes specific details for the purpose of providing a thorough understanding of the subject technology. However, it will be apparent to those skilled in the art that the subject technology may be practiced without these specific details. In some instances, well-known structures and components are shown in block diagram form in order to avoid obscuring the concepts of the subject technology. Like components are labeled with identical element numbers for ease of understanding.

In some embodiments, an mRNA encoding a Cystic Fibrosis Transmembrane Conductance Regulator (CFTR)

protein is provided, wherein the mRNA comprises an open reading frame (ORF) having about 80% sequence identity with one of SEQ ID NOs: 100-105. In some embodiments, the ORF has about 85% sequence identity with one of SEQ ID NOs: 100-105. In some embodiments, the ORF has about 90% sequence identity with one of SEQ ID NOs: 100-105. In some embodiments, the ORF has about 95% sequence identity with one of SEQ ID NOs: 100-105. In some embodiments, the ORF has about 96% sequence identity with one of SEQ ID NOs: 100-105. In some embodiments, the ORF has about 97% sequence identity with one of SEQ ID NOs: 100-105. In some embodiments, the ORF has about 98% sequence identity with one of SEQ ID NOs: 100-105. In some embodiments, the ORF has about 99% sequence identity with one of SEQ ID NOs: 100-105. In some embodiments, the ORF has a sequence selected from the group consisting of SEQ ID NOs: 100-105. In some embodiments, the ORF has the sequence of SEQ ID NO: 100. In some embodiments, the ORF has the sequence of SEQ ID NO: 101. In some embodiments, the ORF has the sequence of SEQ ID NO: 102. In some embodiments, the ORF has the sequence of SEQ ID NO: 103. In some embodiments, the ORF has the sequence of SEQ ID NO: 104. In some embodiments, the ORF has the sequence of SEQ ID NO: 105.

In some embodiments, the mRNA further comprises a 5' untranslated region (5' UTR). In some embodiments, the 5' UTR comprises a sequence selected from SEQ ID NOs: 106-125. In some embodiments, the 5' UTR comprises SEQ ID NO: 106.

In some embodiments, the mRNA further comprises a 3' untranslated region (3' UTR). In some embodiments, the 3' UTR comprises a sequence selected from the group consisting of SEQ ID NOs: 126-145. In some embodiments, the 3' UTR comprises SEQ ID NO: 126.

In some embodiments, the mRNA further comprises a 3' poly-adenosine (poly-A) tail. In some embodiments, the 3' poly-A tail consists of about 50 to about 120 adenosine monomers.

In some embodiments, the mRNA further comprises a 5' cap. In some embodiments, the 5' cap is $m^7$GpppGm having the structure of Formula Cap IV disclosed herein wherein $R^1$ and $R^2$ are each OH, $R^3$ is $OCH_3$, each L is a phosphate linked by diester bonds, mRNA is a mRNA of the present disclosure linked at its 5' end, and n is 1. In some embodiments, the 5'cap is $m^7$GpppAmpG having the structure of Formula Cap V disclosed herein wherein $R^1$, $R^2$, and $R^4$ are each OH, n is 1, each L is a phosphate linked by diester bonds, and mRNA is a mRNA of the present disclosure linked at its 5' end.

In some embodiments, the mRNA comprises one or more chemically-modified nucleotides. In some embodiments, the one or more chemically-modified nucleotides are each independently selected from 5-hydroxycytidine, 5-methylcytidine, 5-hydroxymethylcytidine, 5-carboxycytidine, 5-formylcytidine, 5-methoxycytidine, 5-propynylcytidine, 2-thiocytidine, 5-hydroxyuridine, 5-methyluridine, 5,6-dihydro-5-methyluridine, 2'-O-methyluridine, 2'-O-methyl-5-methyluridine, 2'-fluoro-2'-deoxyuridine, 2'-amino-2'-deoxyuridine, 2'-azido-2'-deoxyuridine, 4-thiouridine, 5-hydroxymethyluridine, 5-carboxyuridine, 5-carboxymethylesteruridine, 5-formyluridine, 5-methoxyuridine, 5-propynyluridine, 5-bromouridine, 5-iodouridine, 5-fluorouridine, pseudouridine, 2'-O-methyl-pseudouridine, $N^1$-hydroxypseudouridine, $N^1$-methylpseudouridine, 2'-O-methyl-N-methylpseudouridine, $N^1$-ethylpseudouridine, $N^1$-hydroxymethylpseudouridine, arauridine, $N^6$-methyladenosine, 2-aminoadenosine, 3-methyladenosine, 7-deazaadenosine, 8-oxoadenosine, inosine, thienoguanosine, 7-deazaguanosine, 8-oxoguanosine, and 6-O-methylguanosine. In some embodiments, the one or more chemically-modified nucleotides are $N^1$-methylpseudouridines. In some embodiments, the one or more chemically-modified nucleotides are 5-methoxyuridines. In some embodiments, the one or more chemically-modified nucleotides are a combination of 5-methylcytidines and $N^1$-methylpseudouridines. In some embodiments, the one or more chemically-modified nucleotides are a combination of 5-methoxyuridines and $N^1$-methylpseudouridines. In some embodiments, the one or more chemically-modified nucleotides are a combination of 5-methoxyuridines, 5-methylcytidines and $N^1$-methylpseudouridines. In some embodiments, the one or more chemically-modified nucleotides comprise 1-99% of the nucleotides. In some embodiments, the one or more chemically-modified nucleotides comprise 50-99% of the nucleotides.

In some embodiments, the ORF is translatable in a mammalian cell to express the human CFTR protein having CFTR activity. In some embodiments, the ORF is translatable in a subject in vivo to express the human CFTR protein having CFTR activity.

In some embodiments, the mRNA comprises a sequence selected from SEQ ID NOs: 49, 53, 66, 68, 69, and 72. In some embodiments, the mRNA comprises SEQ ID NO: 49. In some embodiments, the mRNA comprises SEQ ID NO: 53. In some embodiments, the mRNA comprises SEQ ID NO: 66. In some embodiments, the mRNA comprises SEQ ID NO: 68. In some embodiments, the mRNA comprises SEQ ID NO: 69. In some embodiments, the mRNA comprises SEQ ID NO: 72.

In some embodiments, a pharmaceutical composition comprising an mRNA of of the present disclosure and a lipid of Formula I or a pharmaceutically acceptable salt or solvate thereof is provided, wherein $R^5$ and $R^6$ are each independently selected from the group consisting of a linear or branched $C_1$-$C_{31}$ alkyl, $C_2$-$C_{31}$ alkenyl or $C_2$-$C_{31}$ alkynyl and cholesteryl; $L^5$ and $L^6$ are each independently selected from the group consisting of a linear $C_1$-$C_{20}$ alkyl and $C_2$-$C_{20}$ alkenyl; $X^5$ is —C(O)O— or —OC(O)—; $X^6$ is —C(O)O— or —OC(O)—; $X^7$ is S or O; $L^7$ is absent or lower alkyl; $R^4$ is a linear or branched $C_1$-$C_6$ alkyl; and $R^7$ and $R^8$ are each independently selected from the group consisting of a hydrogen and a linear or branched $C_1$-$C_6$ alkyl.

In some embodiments, a pharmaceutical composition comprising an mRNA of the present disclosure and a lipid selected from an ionizable cationic lipid specifically disclosed herein or a pharmaceutically acceptable salt thereof is provided.

In some embodiments, the pharmaceutical composition further comprises a pharmaceutically acceptable carrier. In some embodiments, the carrier comprises a transfection reagent, a nanoparticle, or a liposome. In some embodiments, the pharmaceutical composition comprises lipid nanoparticles. In some embodiments, the lipid nanoparticles encapsulate at least about 50% of the mRNA. In some embodiments, the lipid nanoparticles comprise a cationic lipid, a helper lipid, a cholesterol, and a PEG-lipid conjugate. In some embodiments, the lipid nanoparticles have a size less than about 100 nm. In some embodiments, the lipid nanoparticles have an average particles size of between about 50 and about 85 nm.

In some embodiments, the helper lipid is selected from dioleoylphosphatidyl ethanolamine (DOPE), dimyristoylphosphatidyl choline (DMPC), distearoylphosphatidyl choline (DSPC), dimyristoylphosphatidyl glycerol (DMPG), dipalmitoyl phosphatidylcholine (DPPC), DOTAP, DOTMA, and phosphatidylcholine (PC) or combination of any of the foregoing. In some embodiments, the helper lipid is distearoylphosphatidylcholine (DSPC).

In some embodiments, the PEG-lipid conjugate is PEG-DMG. In some embodiments, the PEG-DMG is PEG2000-DMG.

In some embodiments, the lipid nanoparticles comprise between about 20 mol % and 40 mol % of the cationic lipid; between about 25 mol % and 35 mol % of helper lipid; between about 25 mol % and 42 mol % cholesterol; and between about 0.5 mol % and 3 mol % PEG2000-DMG.

In some embodiments, the lipid nanoparticles comprise between about 20 mol % and 30 mol % of the cationic lipid; between about 30 mol % and 40 mol % of helper lipid; between about 34 mol % and 42 mol % cholesterol; and between about 1 mol % and 2 mol % PEG2000-DMG.

In some embodiments, the lipid nanoparticles comprise between about 22 mol % and 28 mol % of the cationic lipid; between about 31 mol % and 39 mol % of helper lipid; between about 35 mol % and 40 mol % cholesterol; and between about 1.25 mol % and 1.75 mol % PEG2000-DMG.

In some embodiments, the pharmaceutical composition has a total lipid:mRNA weight ratio of between about 8:1 and 40:1. In some embodiments, the pharmaceutical composition has a total lipid:mRNA weight ratio of between about 10:1 and 30:1. In some embodiments, the pharmaceutical composition has a total lipid:mRNA weight ratio of between about 15:1 and 30:1. In some embodiments, the pharmaceutical composition has a total lipid:mRNA weight ratio of between about 10:1 and 25:1. In some embodiments, the pharmaceutical composition comprises between about 20 w/w % and 60 w/w % of the cationic lipid.

In some embodiments, the pharmaceutical composition is provided for use in medical therapy. In some embodiments, the pharmaceutical composition is provided for use in the treatment of the human or animal body.

In some embodiments, use of the pharmaceutical composition for manufacturing a medicament for ameliorating, preventing, delaying onset, or treating a disease or disorder associated with reduced activity of Cystic Fibrosis Transmembrane Conductance Regulator (CFTR) in a subject need thereof is provided. In some embodiments, the disease is Cystic Fibrosis having a Cystic Fibrosis mutation selected from Class TA, Class 1B, Class 3, Class 4, Class 5 and Class 6. In some embodiments, the Cystic Fibrosis mutation is Class TA. In some embodiments, the Cystic Fibrosis mutation is Class 1B. In some embodiments, the Cystic Fibrosis mutation is Class 3. In some embodiments, the Cystic Fibrosis mutation is Class 4. In some embodiments, the Cystic Fibrosis mutation is Class 5. In some embodiments, the Cystic Fibrosis mutation is Class 6.

In some embodiments, a method for ameliorating, preventing, delaying onset, or treating a disease or disorder associated with reduced activity of Cystic Fibrosis Transmembrane Conductance Regulator (CFTR) in a subject in need thereof is provided comprising administering to the subject one or more mRNA sequences or a pharmaceutical composition described herein. In some embodiments, the disease is Cystic Fibrosis. In some embodiments, the administration is intravenous, subcutaneous, pulmonary, intramuscular, intraperitoneal, dermal, oral, nasal, or inhalation. In some embodiments, the administration is nasal or inhalation. In some embodiments, the administration is inhalation. In some embodiments, the administration is once daily, weekly, biweekly, or monthly. In some embodiments, the administration comprises an effective dose of from 0.01 to 10 mg/kg. In some embodiments, the administration increases expression of CFTR in the lung epithelium.

In some embodiments, a method of expressing a CFTR protein in a cell is provided comprising contacting the cell with one or more mRNA sequences or a pharmaceutical composition described herein.

In some embodiments, a kit for expressing a human CFTR in vivo is provided, the kit comprising a 0.1 to 500 mg dose of an mRNA or a pharmaceutical composition described herein; and a device for administering the dose. In some embodiments, the device is an injection needle, an intravenous needle, or an inhalation device. In some embodiments, the device is an inhalation device.

Human CFTR

In some embodiments, a mRNA sequence is provided comprising an mRNA coding sequence encoding the human CFTR protein. The sequence of the naturally occurring human CFTR protein is provided in SEQ ID NO: 93.

In some embodiments, the mRNA encodes a protein substantially identical to human CFTR protein. In some embodiments, the mRNA encodes an amino acid sequence that is at least 80%, 85%, 90%, 91%, 92%, 93%, 94%, 95%, 96%, 97%, 98%, 99% or more identical to SEQ ID NO: 93. In embodiments, the mRNA encodes an amino acid sequence that is at least 80% or more identical to SEQ ID NO: 93. In embodiments, the mRNA encodes an amino acid sequence that is at least 85% or more identical to SEQ ID NO: 93. In embodiments, the mRNA encodes an amino acid sequence that is at least 90% or more identical to SEQ ID NO: 93. In embodiments, the mRNA encodes an amino acid sequence that is at least 91% or more identical to SEQ ID NO: 93. In embodiments, the mRNA encodes an amino acid sequence that is at least 92% or more identical to SEQ ID NO: 93. In embodiments, the mRNA encodes an amino acid sequence that is at least 93% or more identical to SEQ ID NO: 93. In embodiments, the mRNA encodes an amino acid sequence that is at least 94% or more identical to SEQ ID NO: 93. In embodiments, the mRNA encodes an amino acid sequence that is at least 95% or more identical to SEQ ID NO: 93. In embodiments, the mRNA encodes an amino acid sequence that is at least 96% or more identical to SEQ ID NO: 93. In embodiments, the mRNA encodes an amino acid sequence that is at least 97% or more identical to SEQ ID NO: 93. In embodiments, the mRNA encodes an amino acid sequence that is at least 98% or more identical to SEQ ID NO: 93. In embodiments, the mRNA encodes an amino acid sequence that is at least 99% or more identical to SEQ ID NO: 93. In some embodiments, the mRNA encodes a protein having hCFTR activity having the sequence of SEQ ID NO: 93. In some embodiments, an mRNA suitable for the present disclosure encodes a fragment or a portion of human CFTR protein.

In some embodiments, the disclosure provides an mRNA sequence that encodes a homolog or variant of human CFTR. As used herein, a homolog or a variant of human CFTR protein may be a modified human CFTR protein containing one or more amino acid substitutions, deletions, and/or insertions as compared to a wild-type or naturally-occurring human CFTR protein while retaining substantial CFTR protein activity. In some embodiments, the mRNA encodes a protein selected from SEQ ID NOs: 95, 96, 97, and 99, or a fragment thereof. In some embodiments, the mRNA encodes an amino acid sequence that is at least 80%, 85%, 90%, 91%, 92%, 93%, 94%, 95%, 96%, 97%, 98%, 99% or more identical to SEQ ID NOs: 95, 96, 97, and 99.

In some embodiments, the mRNA encodes an amino acid sequence that is at least 80%, 85%, 90%, 91%, 92%, 93%, 94%, 95%, 96%, 97%, 98%, 99% or more identical to SEQ ID NO: 95. In some embodiments, the mRNA encodes an amino acid sequence that is at least 80%, 85%, 90%, 91%, 92%, 93%, 94%, 95%, 96%, 97%, 98%, 99% or more identical to SEQ ID NO: 96. In some embodiments, the mRNA encodes an amino acid sequence that is at least 80%, 85%, 90%, 91%, 92%, 93%, 94%, 95%, 96%, 97%, 98%, 99% or more identical to SEQ ID NO: 97. In some embodiments, the mRNA encodes an amino acid sequence that is at least 80%, 85%, 90%, 91%, 92%, 93%, 94%, 95%, 96%, 97%, 98%, 99% or more identical to SEQ ID NO: 99. In some embodiments, the mRNA encodes a protein having hCFTR activity having the sequence of SEQ ID NO: 99.

In some embodiments, an mRNA suitable for the present disclosure encodes a fragment or a portion of human CFTR protein, wherein the fragment or portion of the protein still maintains CFTR activity similar to or improved upon that of the wild-type protein.

In some embodiments, an mRNA suitable for the present disclosure comprises a sequence that is at least 80%, 85%, 90%, 91%, 92%, 93%, 94%, 95%, 96%, 97%, 98%, 99% or more identical to SEQ ID NOs: 49, 53, 66, 68, 69, or 72. In some embodiments, an mRNA provided herein comprises a sequence selected from SEQ ID NOs: 49, 53, 66, 68, 69, and 72.

In some embodiments, a mRNA of the present disclosure comprises a coding sequence that is at least 80%, 85%, 90%, 91%, 92%, 93%, 94%, 95%, 96%, 97%, 98%, 99% or more identical to SEQ ID NOs: 100, 101, 102, 103, 104, or 105. In some embodiments, an mRNA comprises a coding sequence that is at least 80%, 85%, 90%, 91%, 92%, 93%, 94%, 95%, 96%, 97%, 98%, 99% or more identical to SEQ ID NOs: 100, 101, 102, 103, 104, or 105, and further comprises one or more components selected from a 5' cap, a 5' UTR, a translation initiation sequence, a 3' UTR, and a tail region. In some embodiments, an mRNA provided herein comprises a coding sequence selected from SEQ ID NOs: 100, 101, 102, 103, 104, and 105. In some embodiments, an mRNA provided herein comprises a coding sequence selected from SEQ ID NOs: 100, 101, 102, 103, 104, and 105, and further comprises one or more components selected from a 5' cap, a 5' UTR, a translation initiation sequence, a 3' UTR, and a tail region.

In some embodiments, an mRNA of the disclosure provides a fusion protein comprising a full length, fragment or portion of a CFTR protein fused to another sequence (e.g., an N or C terminal fusion). In some embodiments, the N or C terminal sequence is a signal sequence or a cellular targeting sequence.

Translatable mRNA Sequences and Constructs

The compositions and methods of the present disclosure include a mRNA that encodes an active and functional CFTR protein. The mRNA can include several features that enhance its in vivo half-life and translation efficiency. In addition, the present disclosure provides for DNA scaffolds for producing an mRNA encoding an active and functional CFTR protein via transcription. The DNA scaffold can be any suitable form of DNA including a plasmid DNA. The polynucleotides contemplated by the present disclosure are further described in detail below.

An mRNA of this disclosure comprising a coding sequence encoding a functional CFTR moiety can be delivered to a patient in need (e.g., CF patient), and can elevate active CFTR levels of the patient. The mRNA sequence can be used for preventing, treating, ameliorating or reversing any symptoms of Cystic Fibrosis in the patient. As will be appreciated by the skilled artisan equipped with the present disclosure, the mRNA sequences and constructs of the present disclosure may be used to ameliorate, prevent, or treat any disease or disorder associated with reduced activity (e.g., resulting from reduced concentration, presence, and/or function) of Cystic Fibrosis Transmembrane Conductance Regulator (CFTR) and/or a disease associated with reduced presence or function of CFTR in a subject.

The mRNA sequences and constructs of this disclosure can have long half-life, particularly in the cytoplasm. They can be used for ameliorating, preventing, or treating a disease or disorder associated with reduced activity (e.g., resulting from reduced concentration, presence, and/or function) of Cystic Fibrosis Transmembrane Conductance Regulator (CFTR) in a subject.

The properties of the mRNA sequences and constructs of this disclosure arise according to their molecular structure, and the structure of the molecule in its entirety, as a whole, can provide significant benefits based on those properties. Embodiments of this disclosure can provide mRNA sequences and constructs having one or more properties that advantageously provide enhanced protein concentration or increased protein activity. The sequences and constructs can further be used in pharmaceutical compositions of this disclosure for ameliorating, preventing, or treating any disease or disorder associated with reduced activity (e.g., resulting from reduced concentration, presence, and/or function) of Cystic Fibrosis Transmembrane Conductance Regulator (CFTR) in a subject.

This disclosure herein provides a range of mRNA sequences that show a surprising degree of translatability to provide active polypeptide or protein, in vitro, ex vivo, and in vivo.

The mRNA sequences, constructs, and compositions can have increased translational activity or cytoplasmic half-life. In these embodiments, the mRNA sequences, constructs, and compositions can provide increased functional half-life in the cytoplasm of mammalian cells, as compared to a native mRNA (i.e., an mRNA transcribed in vivo from the cell's own genome).

In additional embodiments, an mRNA sequence can contain one or more UNA monomers in a 3' untranslated region of monomers.

In further embodiments, an mRNA sequence can contain one or more UNA monomers in a tail region of monomers.

In further embodiments, an mRNA sequence can contain one or more UNA monomers in a poly-A tail.

In some embodiments, an mRNA sequence can contain one or more LNA monomers in a 3' untranslated region of monomers or in a tail region of monomers, e.g., in a poly-A tail.

In another aspect, an mRNA sequence of this disclosure can exhibit at least 2-fold, 3-fold, 5-fold, or 10-fold increased translation efficiency in vivo as compared to a native mRNA that encodes the same translation product.

In a further aspect, an mRNA sequence can produce at least a 2-fold, 3-fold, 5-fold, or 10-fold increased polypeptide or protein level in vivo as compared to a native mRNA that encodes the same polypeptide or protein.

In certain embodiments, an mRNA sequence can provide increased levels of a polypeptide or protein in vivo as compared to a native mRNA that encodes the same polypeptide or protein. For example, the level of a polypeptide or protein can be increased by 10%, or 20%, or 30%, or 40%, or 50%, or more.

In additional embodiments, this disclosure provides methods for treating a disease or condition in a subject by administering to the subject a composition containing an mRNA sequence of the disclosure.

An mRNA sequence of this disclosure may be used for ameliorating, preventing or treating a disease or disorder, e.g., a disease or disorder associated with reduced activity (e.g., resulting from reduced concentration, presence, and/or function) of Cystic Fibrosis Transmembrane Conductance Regulator (CFTR) in a subject. In these embodiments, a composition comprising an mRNA sequence of this disclosure can be administered to regulate, modulate, or increase the concentration or effectiveness of CFTR in a subject. In one aspect, the protein can be an unmodified, natural protein for which the patient has an abnormal quantity (e.g., a patient with a mutated version of CFTR which partially or totally abolishes CFTR activity). In one aspect, the protein can be an unmodified, natural CFTR protein which can be used to treat a patient harboring a mutated version of CFTR. In embodiments, an mRNA sequence of this disclosure may be used for ameliorating, preventing or treating Cystic Fibrosis.

In some embodiments, an mRNA sequence may be delivered to cells or subjects and translated to increase CFTR levels in the cell or subject.

In an embodiment, a subject of the present disclosure is a subject with reduced activity (e.g., resulting from reduced concentration, presence, and/or function) of Cystic Fibrosis Transmembrane Conductance Regulator (CFTR). In a further embodiment, the subject is a human.

In some embodiments, administering a composition comprising an mRNA sequence of the disclosure can result in increased CFTR protein levels in a treated subject. In some embodiments, administering a composition comprising an mRNA sequence of the disclosure results in about a 5%, 10%, 20%, 30%, 40%, 50%, 60%, 70%, 80%, 90%, or 95% increase in CFTR protein levels relative to a baseline CFTR protein level in the subject prior to treatment. In an embodiment, administering a composition comprising an mRNA sequence of the disclosure results in an increase in CFTR levels relative to baseline CFTR levels in the subject prior to treatment. In some embodiments, the increase in CFTR levels can be at least about 5%, 10%, 20%, 30%, 40%, 50%, 100%, 200%, or more.

In embodiments, the CFTR protein is expressed in the lung of a treated subject.

In some embodiments, administering a composition comprising an mRNA sequence of the disclosure results in the expression of a natural, non-mutated human CFTR (i. e., normal or wild-type CFTR as opposed to abnormal or mutated CFTR) protein level at or above about 10 ng/mg, about 20 ng/mg, about 50 ng/mg, about 100 ng/mg, about 150 ng/mg, about 200 ng/mg, about 250 ng/mg, about 300 ng/mg, about 350 ng/mg, about 400 ng/mg, about 450 ng/mg, about 500 ng/mg, about 600 ng/mg, about 700 ng/mg, about 800 ng/mg, about 900 ng/mg, about 1000 ng/mg, about 1200 ng/mg or about 1500 ng/mg of the total protein in the lung epithelial cells of a treated subject.

In some embodiments, the expression of the natural, non-mutated human CFTR protein is detectable 6, 12, 18, 24, 30, 36, 48, 60, and/or 72 hours after administration of a composition comprising an mRNA sequence of the disclosure. In some embodiments, the expression of the natural, non-mutated human CFTR protein is detectable 1 day, 2 days, 3 days, 4 days, 5 days, 6 days, and/or 7 days after administration of a composition comprising an mRNA sequence of the disclosure. In some embodiments, the expression of the natural, non-mutated human CFTR protein is detectable 1 week, 2 weeks, 3 weeks, and/or 4 weeks after the administration. In some embodiments, the expression of the natural, non-mutated human CFTR protein is detectable after administration of a composition comprising an mRNA sequence of the disclosure. In some embodiments, expression of natural, non-mutated human CFTR protein is detectable after administration of a composition comprising an mRNA sequence of the disclosure.

Design and Synthesis of mRNA Sequences

The mRNA agents of the present disclosure may be obtained by any suitable means. Methods for the manufacture of mRNA are known in the art and would be readily apparent to a person of ordinary skill. An mRNA of the present disclosure may be prepared according to any available technique including, but not limited to chemical synthesis, in vitro transcription (IVT) or enzymatic or chemical cleavage of a longer precursor, etc.

In some embodiments, mRNA is produced from a primary complementary DNA (cDNA) construct. The cDNA constructs can be produced on an RNA template by the action of a reverse transcriptase (e.g., RNA-dependent DNA-polymerase). The process of design and synthesis of the primary cDNA constructs described herein generally includes the steps of gene construction, mRNA production (either with or without modifications) and purification. In the IVT method, a target polynucleotide sequence encoding a CFTR protein is first selected for incorporation into a vector, which will be amplified to produce a cDNA template. Optionally, the target polynucleotide sequence and/or any flanking sequences may be codon optimized. The cDNA template is then used to produce mRNA through in vitro transcription (IVT). After production, the mRNA may undergo purification and clean-up processes, the steps of which are provided in more detail below.

The step of gene construction may include, but is not limited to gene synthesis, vector amplification, plasmid purification, plasmid linearization and clean-up, and cDNA template synthesis and clean-up. Once a human CFTR protein (e.g. SEQ ID NOs: 93 or 99) is selected for production, a primary construct is designed. Within the primary construct, a first region of linked nucleosides encoding the polypeptide of interest may be constructed using an open reading frame (ORF) of a selected nucleic acid (DNA or RNA) transcript. The ORF may comprise the wild type ORF, an isoform, variant or a fragment thereof. As used herein, an “open reading frame” or “ORF” is meant to refer to a nucleic acid sequence (DNA or RNA) which is capable of encoding a polypeptide of interest. ORFs often begin with the start codon, ATG and end with a nonsense or termination codon or signal.

The cDNA templates may be transcribed to produce an mRNA sequence described herein using an in vitro transcription (IVT) system. The system typically comprises a transcription buffer, nucleotide triphosphates (NTPs), an RNase inhibitor and a polymerase. The NTPs may be selected from, but are not limited to, those described herein including natural and unnatural (modified) NTPs. The polymerase may be selected from, but is not limited to, T7 RNA polymerase, T3 RNA polymerase and mutant polymerases such as, but not limited to, polymerases able to incorporate modified nucleic acids.

The primary cDNA template or transcribed mRNA sequence may also undergo capping and/or tailing reactions. A capping reaction may be performed by methods known in the art to add a 5' cap to the 5' end of the primary construct. Methods for capping include, but are not limited to, using a Vaccinia Capping enzyme (New England Biolabs, Ipswich, Mass.) or capping at initiation of in vitro transcription, by for example, including a capping agent as part of the IVT reaction. (Nuc. Acids Symp. (2009) 53:129). A poly-A tailing reaction may be performed by methods known in the art, such as, but not limited to, 2' O-methyltransferase and by methods as described herein. If the primary construct generated from cDNA does not include a poly-T, it may be beneficial to perform the poly-A-tailing reaction before the primary construct is cleaned.

Codon optimized cDNA constructs encoding a Cystic Fibrosis Transmembrane Conductance Regulator (CFTR) protein are particularly suitable for generating mRNA sequences described herein. For example, such cDNA constructs may be used as the basis to transcribe, in vitro, a polyribonucleotide encoding a Cystic Fibrosis Transmembrane Conductance Regulator (CFTR) protein.

Examples of DNA ORF sequences are provided in SEQ ID Nos: 1-46, which provide sequences which can be used in developing materials for transcription to an mRNA of the present disclosure. SEQ ID NO: 1 provides the DNA ORF of a reference hCFTR protein (construct 764) commonly used in the art as a reference sequence in which the sequence is slightly modified from the wild-type having a point mutation in the coding region to remove an internal cryptic promoter. Preferred DNA ORF sequences include the DNA sequence of SEQ ID NOs: 3, 5, 7, 20, 22, 23, or 26. In some embodiment, the DNA ORF comprises a sequence of SEQ ID NO: 7, which has an optimized coding sequence encoding a CFTR protein of SEQ ID NO: 93. It will be appreciated that T present in DNA is substituted with U in RNA, and vice versa.

The present disclosure also provides expression vectors comprising a nucleotide sequence encoding a CFTR protein that is preferably operably linked to at least one regulatory sequence. Regulatory sequences are art-recognized and are selected to direct expression of the encoded polypeptide.

Accordingly, the term regulatory sequence includes promoters, enhancers, and other expression control elements. The design of the expression vector may depend on such factors as the choice of the host cell to be transformed and/or the type of protein desired to be expressed.

The present disclosure also provides polynucleotides (e.g. DNA, RNA, cDNA, mRNA, etc.) encoding a human CFTR protein that may be operably linked to one or more regulatory nucleotide sequences in an expression construct, such as a vector or plasmid. In certain embodiments, such constructs are DNA constructs. Regulatory nucleotide sequences will generally be appropriate for a host cell used for expression. Numerous types of appropriate expression vectors and suitable regulatory sequences are known in the art for a variety of host cells.

Typically, said one or more regulatory nucleotide sequences may include, but are not limited to, promoter sequences, leader or signal sequences, ribosomal binding sites, transcriptional start and termination sequences, translational start and termination sequences, and enhancer or activator sequences. Constitutive or inducible promoters as known in the art are contemplated by the embodiments of the present disclosure. The promoters may be either naturally occurring promoters, or hybrid promoters that combine elements of more than one promoter.

An expression construct may be present in a cell on an episome, such as a plasmid, or the expression construct may be inserted in a chromosome. In some embodiments, the expression vector contains a selectable marker gene to allow the selection of transformed host cells. Selectable marker genes are well known in the art and will vary with the host cell used.

The present disclosure also provides a host cell transfected with an mRNA or DNA described herein which encodes a CFTR polypeptide described herein. In some embodiments, the human CFTR polypeptide has the sequence of SEQ ID NO: 99. The host cell may be any prokaryotic or eukaryotic cell. For example, a CFTR polypeptide may be expressed in bacterial cells such as *E. coli*, insect cells (e.g., using a baculovirus expression system), yeast, or mammalian cells. Other suitable host cells are known to those skilled in the art.

The present disclosure also provides a host cell comprising a vector comprising a polynucleotide of SEQ ID NOs: 2-46.

The present disclosure also provides methods of producing a human wild type CFTR protein of SEQ ID NO: 93. For example, a host cell transfected with an expression vector encoding a CFTR protein can be cultured under appropriate conditions to allow expression of the polypeptide to occur. The polypeptide may be secreted and isolated from a mixture of cells and medium containing the polypeptides. Alternatively, the polypeptides may be retained in the cytoplasm or in a membrane fraction and the cells harvested, lysed and the protein isolated. A cell culture includes host cells, media and other byproducts. Suitable media for cell culture are well known in the art.

The expressed CFTR proteins described herein can be isolated from cell culture medium, host cells, or both using techniques known in the art for purifying proteins, including ion-exchange chromatography, gel filtration chromatography, ultrafiltration, electrophoresis, and immunoaffinity purification with antibodies specific for particular epitopes of the CFTR polypeptide.

Codon Optimization

A polynucleotide sequence encoding a protein can be altered relative to the wild type for the same sequence to select the best combination of codons that code for the amino acids of the protein. For an mRNA, all or a portion of the mRNA, for example, the coding region or open reading frame (ORF), can be optimized with respect to the codons in that region. Codon-optimized sequences can increase protein expression levels (Gustafsson et al., Codon bias and heterologous protein expression. 2004, Trends Biotechnol 22: 346-53) of the encoded proteins while providing other advantages. Optimization of the codons in a sequence will depend on several characteristics of an mRNA construct including high codon adaptation index (CAI), the Low-U method, mRNA secondary structures, cis-regulatory sequences, GC content and many other similar variables. These variables have been shown to correlate with protein expression levels (Villalobos et al., Gene Designer: a synthetic biology tool for constructing artificial DNA segments. 2006, BMC Bioinformatics 7:285). The high CAI (codon adaptation index) method picks a most frequently used synonymous codon for an entire protein coding sequence. The most frequently used codon for each amino acid is deduced from 74,218 protein-coding genes from a human genome. The Low-U method targets only U-containing codons that can be replaced with a synonymous codon with fewer U moieties. If there are a few choices for the replacement, the more frequently used codon will be selected. The remaining codons in the sequence are not changed by the Low-U method. This method may be used in conjunction with the disclosed mRNAs to design coding sequences that are to be synthesized with, for example, 5-methoxyuridine or $N^1$-methyl pseudouridine. Methods of codon optimization in combination with the use of a modified nucleotide monomer are described in U.S. 2018/0327471, the contents of which are herein incorporated by reference.

In addition, the nucleotide sequence of any region of the mRNA or DNA template may be codon optimized. Codon optimization methods are known in the art and may be useful in efforts to achieve one or more of several goals. These goals include to match codon frequencies in target and host organisms to ensure proper folding, to bias GC nucleotide pair content to increase mRNA stability or reduce secondary structures, to minimize tandem repeat codons or base runs that may impair gene construction or expression, to customize transcriptional and translational control regions, to insert or remove protein trafficking sequences, to remove/add post translation modification sites in encoded protein (e.g. glycosylation sites), to add, remove or shuffle protein domains, to insert or delete restriction sites, to modify ribosome binding sites and mRNA degradation sites, to adjust translational rates to allow the various domains of the protein to fold properly, or to reduce or eliminate problematic secondary structures within the mRNA. Suitable codon optimization tools, algorithms and services are known in the art.

In some embodiments, the nucleotide sequence of any region of the mRNA or DNA templates described herein may be codon-optimized. Preferably, the primary cDNA template may include reducing the occurrence or frequency of appearance of certain nucleotides in the template strand. For example, the occurrence of a nucleotide in a template may be reduced to a level below 25% of said nucleotides in the template. In further examples, the occurrence of a nucleotide in a template may be reduced to a level below 20% of said nucleotides in the template. In some examples, the occurrence of a nucleotide in a template may be reduced to a level below 16% of said nucleotides in the template. Preferably, the occurrence of a nucleotide in a template may be reduced to a level below 15%, and preferably may be reduced to a level below 12% of said nucleotides in the template.

In some embodiments, the nucleotide reduced is uridine. For example, the present disclosure provides nucleic acids with altered uracil content wherein at least one codon in the wild-type sequence has been replaced with an alternative codon to generate a uracil-altered sequence. Altered uracil sequences can have at least one of the following properties:

(i) an increase or decrease in global uracil content (i.e., the percentage of uracil of the total nucleotide content in the nucleic acid of a section of the nucleic acid, e.g., the open reading frame);

(ii) an increase or decrease in local uracil content (i.e., changes in uracil content are limited to specific subsequences);

(iii) a change in uracil distribution without a change in the global uracil content;

(iv) a change in uracil clustering (e.g., number of clusters, location of clusters, or distance between clusters); or (v) combinations thereof.

In some embodiments, the percentage of uracil nucleobases in the nucleic acid sequence is reduced with respect to the percentage of uracil nucleobases in the wild-type nucleic acid sequence. For example, 30% of nucleobases may be uracil in the wild-type sequence but the nucleobases that are uracil are preferably lower than 15%, preferably lower than 12% and preferably lower than 10% of the nucleobases in the nucleic acid sequences of the disclosure. The percentage uracil content can be determined by dividing the number of uracil in a sequence by the total number of nucleotides and multiplying by 100.

In some embodiments, the percentage of uracil nucleobases in a subsequence of the nucleic acid sequence is reduced with respect to the percentage of uracil nucleobases in the corresponding subsequence of the wild-type sequence. For example, the wild-type sequence may have a 5'-end region (e.g., 30 codons) with a local uracil content of 30%, and the uracil content in that same region could be reduced to preferably 15% or lower, preferably 12% or lower and preferably 10% or lower in the nucleic acid sequences of the disclosure. These subsequences can also be part of the wild-type sequences of the heterologous 5' and 3' UTR sequences of the present disclosure.

In some embodiments, codons in the nucleic acid sequence of the disclosure reduce or modify, for example, the number, size, location, or distribution of uracil clusters that could have deleterious effects on protein translation. Although lower uracil content is desirable in certain aspects, the uracil content, and in particular the local uracil content, of some subsequences of the wild-type sequence can be greater than the wild-type sequence and still maintain beneficial features (e.g., increased expression).

In some embodiments, the uracil-modified sequence induces a lower Toll-Like Receptor (TLR) response when compared to the wild-type sequence. Several TLRs recognize and respond to nucleic acids. Double-stranded (ds) RNA, a frequent viral constituent, has been shown to activate TLR3. Single-stranded (ss)RNA activates TLR7. RNA oligonucleotides, for example RNA with phosphorothioate internucleotide linkages, are ligands of human TLR8. DNA containing unmethylated CpG motifs, characteristic of bacterial and viral DNA, activate TLR9.

As used herein, the term "TLR response" is defined as the recognition of single-stranded RNA by a TLR7 receptor, and preferably encompasses the degradation of the RNA and/or physiological responses caused by the recognition of the single-stranded RNA by the receptor. Methods to determine and quantify the binding of an RNA to a TLR7 are known in the art. Similarly, methods to determine whether an RNA has triggered a TLR7-mediated physiological response (e.g., cytokine secretion) are well known in the art. In some embodiments, a TLR response can be mediated by TLR3, TLR8, or TLR9 instead of TLR7. Suppression of TLR7-mediated response can be accomplished via nucleoside modification. RNA undergoes over a hundred different nucleoside modifications in nature. Human rRNA, for example, has ten times more pseudouracil ('P) and 25 times more 2'-O-methylated nucleosides than bacterial rRNA. Bacterial mRNA contains no nucleoside modifications, whereas mammalian mRNAs have modified nucleosides such as 5-methylcytidine ($m^5C$), $N^6$-methyladenosine ($m^6A$), inosine and many 2'-O-methylated nucleosides in addition to $N^7$-methylguanosine ($m^7G$).

In some embodiments, the uracil content of polynucleotides disclosed herein and preferably polynucleotides encoding the CFTR protein of SEQ ID NO: 99 is less than about 50%, 49%, 48%, 47%, 46%, 45%, 44%, 43%, 42%, 41%, 40%, 39%, 38%, 37%, 36%, 35%, 34%, 33%, 32%, 31%, 30%, 29%, 28%, 27%, 26%, 25%, 24%, 23%, 22%, 21%, 20%, 19%, 18%, 17%, 16%, 15%, 14%, 13%, 12%, 11%, 10%, 9%, 8%, 7%, 6%, 5%, 4%, 3%, 2% or 1% of the total nucleobases in the polynucleotide sequence. In some embodiments, the uracil content of polynucleotides disclosed herein and preferably polynucleotides encoding the CFTR protein of SEQ ID NO: 99, is between about 5% and about 25%. In some embodiments, the uracil content of polynucleotides disclosed herein and preferably polynucleotides encoding the CFTR protein of SEQ ID NO: 99 is between about 15% and about 25%.

Natural, Modified and Chemically-Modified Nucleotides

Preferably an mRNA described herein comprises one or more chemically modified nucleotides. Examples of nucleic acid monomers include non-natural, modified, and chemically-modified nucleotides, including any such nucleotides known in the art. Nucleotides can be artificially modified at either the base portion or the sugar portion. In nature, most polynucleotides comprise nucleotides that are "unmodified" or "natural" nucleotides, which include the purine bases adenine (A) and guanine (G), and the pyrimidine bases thymine (T), cytosine (C) and uracil (U). These bases are typically fixed to a ribose or deoxy ribose at the 1' position. The use of mRNA polynucleotides comprising chemically modified nucleotides have been shown to improve mRNA expression, expression rates, half-life and/or expressed protein concentrations. Also, mRNA polynucleotides comprising chemically modified nucleotides have been useful in optimizing protein localization, thereby avoiding deleterious bio-responses such as immune responses and/or degradation pathways.

Examples of modified or chemically-modified nucleotides include 5-hydroxycytidines, 5-alkylcytidines, 5-hydroxyalkylcytidines, 5-carboxycytidines, 5-formylcytidines, 5-alkoxycytidines, 5-alkynylcytidines, 5-halocytidines, 2-thiocytidines, N4-alkylcytidines, $N^4$-aminocytidines, $N^4$-acetylcytidines, and $N^4$,$N^4$-dialkylcytidines.

Examples of modified or chemically-modified nucleotides include 5-hydroxycytidine, 5-methylcytidine, 5-hydroxymethylcytidine, 5-carboxycytidine, 5-formylcytidine, 5-methoxycytidine, 5-propynylcytidine, 5-bromocytidine, 5-iodocytidine, 2-thiocytidine; $N^4$-methylcytidine, $N^4$-aminocytidine, $N^4$-acetylcytidine, and $N^4$,$N^4$-dimethylcytidine.

Examples of modified or chemically-modified nucleotides include 5-hydroxyuridines, 5-alkyluridines, 5-hydroxyalkyluridines, 5-carboxyuridines, 5-carboxyalkylesteruridines, 5-formyluridines, 5-alkoxyuridines, 5-alkynyluridines, 5-halouridines, 2-thiouridines, and 6-alkyluridines.

Examples of modified or chemically-modified nucleotides include 5-hydroxyuridine, 5-methyluridine, 5-hydroxymethyluridine, 5-carboxyuridine, 5-carboxymethylesteruridine, 5-formyluridine, 5-methoxyuridine (also referred to herein as "5MeOU"), 5-propynyluridine, 5-bromouridine, 5-fluorouridine, 5-iodouridine, 2-thiouridine, and 6-methyluridine.

Examples of modified or chemically-modified nucleotides include 5-methoxycarbonylmethyl-2-thiouridine, 5-methylaminomethyl-2-thiouridine, 5-carbamoylmethyluridine, 5-carbamoylmethyl-2'-O-methyluridine, 1-methyl-3-(3-amino-3-carboxypropy)pseudouridine, 5-methylaminomethyl-2-selenouridine, 5-carboxymethyluridine, 5-methyldihydrouridine, 5-taurinomethyluridine, 5-taurinomethyl-2-thiouridine, 5-(isopentenylaminomethyl)uridine, 2'-O-methylpseudouridine, 2-thio-2'O-methyluridine, and 3,2'-O-dimethyluridine.

Examples of modified or chemically-modified nucleotides include $N^6$-methyladenosine, 2-aminoadenosine, 3-methyladenosine, 8-azaadenosine, 7-deazaadenosine, 8-oxoadenosine, 8-bromoadenosine, 2-methylthio-$N^6$-methyladenosine, $N^6$-isopentenyladenosine, 2-methylthio-$N^6$-isopentenyladenosine, $N^6$-(cis-hydroxyisopentenyl) adenosine, 2-methylthio-$N^6$-(cis-hydroxyisopentenyl) adenosine, $N^6$-glycinylcarbamoyladenosine, $N^6$-threonylcarbamoyl-adenosine, $N^6$-methyl-$N^6$-threonylcarbamoyl-adenosine, 2-methylthio-$N^6$-threonylcarbamoyladenosine, $N^6$,$N^6$-dimethyladenosine, $N^6$-hydroxynorvalylcarbamoyladenosine, 2-methylthio-$N^6$-hydroxynorvalylcarbamoyl-adenosine, $N^6$-acetyladenosine, 7-methyl-adenine, 2-methylthio-adenine, 2-methoxy-adenine, alpha-thio-adenosine, 2'-O-methyl-adenosine, $N^6$,2'-O-dimethyl-adenosine, $N^6$,$N^6$,2'-O-trimethyl-adenosine, 1,2'-O-dimethyl-adenosine, 2'-O-ribosyladenosine, 2-amino-$N^6$-methyl-purine, 1-thio-adenosine, 2'-F-ara-adenosine, 2'-F-adenosine, 2'-OH-ara-adenosine, and $N^6$-(19-amino-pentaoxanonadecyl)-adenosine.

Examples of modified or chemically-modified nucleotides include $N^1$-alkylguanosines, $N^2$-alkylguanosines, thienoguanosines, 7-deazaguanosines, 8-oxoguanosines, 8-bromoguanosines, O6-alkylguanosines, xanthosines, inosines, and $N^1$-alkylinosines.

Examples of modified or chemically-modified nucleotides include $N^1$-methylguanosine, $N^2$-methylguanosine, thienoguanosine, 7-deazaguanosine, 8-oxoguanosine, 8-bromoguanosine, O6-methylguanosine, xanthosine, inosine, and $N^1$-methylinosine.

Examples of modified or chemically-modified nucleotides include pseudouridines. Examples of pseudouridines include $N^1$-alkylpseudouridines, $N^1$-cycloalkylpseudouridines, $N^1$-hydroxypseudouridines, $N^1$-hydroxyalkylpseudouridines, $N^1$-phenylpseudouridines, $N^1$-phenylalkylpseudouridines, $N^1$-aminoalkylpseudouridines, $N^3$-alkylpseudouridines, $N^6$-alkylpseudouridines, $N^6$-alkoxypseudouridines, $N^6$-hydroxypseudouridines, $N^6$-hydroxyalkylpseudouridines, $N^6$-morpholinopseudouridines, $N^6$-phenylpseudouridines, and $N^6$-halopseudouridines. Examples of pseudouridines include $N^1$-alkyl-$N^6$-alkylpseudouridines, $N^1$-alkyl-$N^6$-alkoxypseudouridines, $N^1$-alkyl-$N^6$-hydroxypseudouridines, $N^1$-alkyl-$N^6$-hydroxyalkylpseudouridines, $N^1$-alkyl-$N^6$-morpholinopseudouridines, $N^1$-alkyl-$N^6$-phenylpseudouridines, and $N^1$-alkyl-$N^6$-halopseudouridines. In these examples, the alkyl, cycloalkyl, and phenyl substituents may be unsubstituted, or further substituted with alkyl, halo, haloalkyl, amino, or nitro substituents.

Examples of pseudouridines include $N^1$-methylpseudouridine (also referred to herein as "N1MPU"), $N^1$-ethylpseudouridine, $N^1$-propylpseudouridine, $N^1$-cyclopropylpseudouridine, $N^1$-phenylpseudouridine, N1-aminomethylpseudouridine, $N^3$-methylpseudouridine, $N^1$-hydroxypseudouridine, and $N^1$-hydroxymethylpseudouridine.

Examples of nucleic acid monomers include modified and chemically-modified nucleotides, including any such nucleotides known in the art.

Examples of modified and chemically-modified nucleotide monomers include any such nucleotides known in the art, for example, 2'-O-methyl ribonucleotides, 2'-O-methyl purine nucleotides, 2'-deoxy-2'-fluoro ribonucleotides, 2'-deoxy-2'-fluoro pyrimidine nucleotides, 2'-deoxy ribonucleotides, 2'-deoxy purine nucleotides, universal base nucleotides, 5-C-methyl-nucleotides, and inverted deoxyabasic monomer residues.

Examples of modified and chemically-modified nucleotide monomers include 3'-end stabilized nucleotides, 3'-glyceryl nucleotides, 3'-inverted abasic nucleotides, and 3'-inverted thymidine.

Examples of modified and chemically-modified nucleotide monomers include locked nucleic acid nucleotides (LNA), 2'-0,4'-C-methylene-(D-ribofuranosyl) nucleotides, 2'-methoxyethoxy (MOE) nucleotides, 2'-methyl-thio-ethyl, 2'-deoxy-2'-fluoro nucleotides, and 2'-O-methyl nucleotides.

In an embodiment, the modified monomer is a locked nucleic acid nucleotide (LNA).

Examples of modified and chemically-modified nucleotide monomers include 2',4'-constrained 2'-O-methoxyethyl (cMOE) and 2'-O-Ethyl (cEt) modified DNAs.

Examples of modified and chemically-modified nucleotide monomers include 2'-amino nucleotides, 2'-O-amino nucleotides, 2'-C-allyl nucleotides, and 2'-O-allyl nucleotides.

Examples of modified and chemically-modified nucleotide monomers include $N^6$-methyladenosine nucleotides.

Examples of modified and chemically-modified nucleotide monomers include nucleotide monomers with modified bases 5-(3-amino)propyluridine, 5-(2-mercapto)ethyluridine, 5-bromouridine; 8-bromoguanosine, or 7-deazaadenosine.

Examples of modified and chemically-modified nucleotide monomers include 2'-O-aminopropyl substituted nucleotides.

Examples of modified and chemically-modified nucleotide monomers include replacing the 2'-OH group of a nucleotide with a 2'-R, a 2'-OR, a 2'-halogen, a 2'-SR, or a 2'-amino, where R can be H, alkyl, alkenyl, or alkynyl.

Example of base modifications described above can be combined with additional modifications of nucleoside or nucleotide structure, including sugar modifications and linkage modifications. Certain modified or chemically-modified nucleotide monomers may be found in nature.

Preferred nucleotide modifications include $N^1$-methylpseudouridine and 5-methoxyuridine.

Examples of modified or chemically-modified nucleotides include 5-hydroxycytidines, 5-alkylcytidines, 5-hydroxyalkylcytidines, 5-carboxycytidines, 5-formylcytidines, 5-alkoxycytidines, 5-alkynylcytidines, 5-halocytidines, 2-thiocytidines, $N^4$-alkylcytidines, $N^4$-aminocytidines, $N^4$-acetylcytidines, and $N^4$,$N^4$-dialkylcytidines.

Examples of modified or chemically-modified nucleotides include 5-hydroxycytidine, 5-methylcytidine, 5-hydroxymethylcytidine, 5-carboxycytidine, 5-formylcytidine, 5-methoxycytidine, 5-propynylcytidine, 5-bromocytidine, 5-iodocytidine, 2-thiocytidine; $N^4$-methylcytidine, $N^4$-aminocytidine, $N^4$-acetylcytidine, and $N^4$,$N^4$-dimethylcytidine.

Examples of modified or chemically-modified nucleotides include 5-hydroxyuridines, 5-alkyluridines, 5-hydroxyalkyluridines, 5-carboxyuridines, 5-carboxyalkylesteruridines, 5-formyluridines, 5-alkoxyuridines, 5-alkynyluridines, 5-halouridines, 2-thiouridines, and 6-alkyluridines.

Examples of modified or chemically-modified nucleotides include 5-hydroxyuridine, 5-methyluridine, 5-hydroxymethyluridine, 5-carboxyuridine, 5-carboxymethylesteruridine, 5-formyluridine, 5-methoxyuridine (also referred to herein as "5MeOU"), 5-propynyluridine, 5-bromouridine, 5-fluorouridine, 5-iodouridine, 2-thiouridine, and 6-methyluridine.

Examples of modified or chemically-modified nucleotides include 5-methoxycarbonylmethyl-2-thiouridine, 5-methylaminomethy-2-thiouridine, 5-carbamoylmethyluridine, 5-carbamoylmethyl-2'-O-methyluridine, 1-methyl-3-(3-amino-3-carboxypropy)pseudouridine, 5-methylaminomethyl-2-selenouridine, 5-carboxymethyluridine, 5-methyldihydrouridine, 5-taurinomethyluridine, 5-taurinomethyl-2-thiouridine, 5-(isopentenylaminomethyl)uridine, 2'-O-methylpseudouridine, 2-thio-2'-O-methyluridine, 3'-O-dimethyluridine, and 2'-O-dimethyluridine.

Examples of modified or chemically-modified nucleotides include $N^6$-methyladenosine, 2-aminoadenosine, 3-methyladenosine, 8-azaadenosine, 7-deazaadenosine, 8-oxoadenosine, 8-bromoadenosine, 2-methylthio-$N^6$-methyladenosine, $N^6$-isopentenyladenosine, 2-methylthio-$N^6$-isopentenyladenosine, $N^6$-(cis-hydroxyisopentenyl) adenosine, 2-methylthio-$N^6$-(cis-hydroxyisopentenyl) adenosine, $N^6$-glycinylcarbamoyladenosine, $N^6$-threonylcarbamoyl-adenosine, $N^6$-methyl-$N^6$-threonylcarbamoyl-adenosine, 2-methylthio-$N^6$-threonylcarbamoyladenosine, $N^6$,$N^6$-dimethyladenosine, $N^6$-hydroxynorvalylcarbamoyladenosine, 2-methylthio-$N^6$-hydroxynorvalylcarbamoyl-adenosine, $N^6$-acetyladenosine, 7-methyl-adenine, 2-methylthio-adenosine, 2-methoxy-adenosine, alpha-thio-adenosine, 2'-O-methyladenosine, $N^6$,2'-O-dimethyl-adenosine, $N^6$,$N^6$,2'-O-trimethyl-adenosine, 2'-O-dimethyl-adenosine, 2'-O-ribosyladenosine, 2-amino-$N^6$-methyl-purine, 1-thio-adenosine, 2'-fluoro-ara-adenosine, 2'-fluoro-adenosine, 2'-OH-ara-adenosine, and $N^6$-(19-amino-pentaoxanonadecyl)-adenosine.

Examples of modified or chemically-modified nucleotides include $N^1$-alkylguanosines, $N^2$-alkylguanosines, thienoguanosines, 7-deazaguanosines, 8-oxoguanosines, 8-bromoguanosines, $O^6$-alkylguanosines, xanthosines, inosines, and $N^1$-alkylinosines.

Examples of modified or chemically-modified nucleotides include $N^1$-methylguanosine, $N^2$-methylguanosine, thienoguanosine, 7-deazaguanosine, 8-oxoguanosine, 8-bromoguanosine, $O^6$-methylguanosine, xanthosine, inosine, and $N^1$-methylinosine.

Examples of modified or chemically-modified nucleotides include pseudouridines. Examples of pseudouridines include $N^1$-alkylpseudouridines, $N^1$-cycloalkylpseudouridines, $N^1$-hydroxypseudouridines, $N^1$-hydroxyalkylpseudouridines, $N^1$-phenylpseudouridines, $N^1$-phenylalkylpseudouridines, $N^1$-aminoalkylpseudouridines, $N^3$-alkylpseudouridines, $N^6$-alkylpseudouridines, $N^6$-alkoxypseudouridines, $N^6$-hydroxypseudouridines, $N^6$-hydroxyalkylpseudouridines, $N^6$-morpholinopseudouridines, $N^6$-phenylpseudouridines, and $N^6$-halopseudouridines. Other examples of pseudouridines include $N^1$-alkyl-$N^6$-alkylpseudouridines, $N^1$-alkyl-$N^6$-alkoxypseudouridines, $N^1$-alkyl-$N^6$-hydroxypseudouridines, $N^1$-alkyl-$N^6$-hydroxyalkylpseudouridines, $N^1$-alkyl-$N^6$-morpholinopseudouridines, $N^1$-alkyl-$N^6$-phenylpseudouridines, and $N^1$-alkyl-$N^6$-halopseudouridines. In these examples, the alkyl, cycloalkyl, and phenyl substituents may be unsubstituted, or further substituted with alkyl, halo, haloalkyl, amino, or nitro substituents.

Examples of pseudouridines include $N^1$-methylpseudouridine (also referred to herein as "N1MPU"), $N^1$-ethylpseudouridine, $N^1$-propylpseudouridine, $N^1$-cyclopropylpseudouridine, $N^1$-phenylpseudouridine, $N^1$-aminomethylpseudouridine, $N^3$-methylpseudouridine, $N^1$-hydroxypseudouridine, and $N^1$-hydroxymethylpseudouridine.

Examples of nucleic acid monomers include modified and chemically-modified nucleotides, including any such nucleotides known in the art.

Examples of modified and chemically-modified nucleotide monomers include any such nucleotides known in the art, for example, 2'-O-methyl ribonucleotides, 2'-O-methyl purine nucleotides, 2'-deoxy-2'-fluoro ribonucleotides, 2'-deoxy-2'-fluoro pyrimidine nucleotides, 2'-deoxy ribonucleotides, 2'-deoxy purine nucleotides, universal base nucleotides, 5-C-methyl-nucleotides, and inverted deoxyabasic monomer residues.

Examples of modified and chemically-modified nucleotide monomers include 3'-end stabilized nucleotides, 3'-glyceryl nucleotides, 3'-inverted abasic nucleotides, and 3'-inverted thymidine.

Examples of modified and chemically-modified nucleotide monomers include locked nucleic acid nucleotides (LNA), 2'-0,4'-C-methylene-(D-ribofuranosyl) nucleotides, 2'-methoxyethoxy (MOE) nucleotides, 2'-methyl-thio-ethyl, 2'-deoxy-2'-fluoro nucleotides, and 2'-O-methyl nucleotides. In an embodiment, the modified monomer is a locked nucleic acid nucleotide (LNA).

Examples of modified and chemically-modified nucleotide monomers include 2',4'-constrained 2'-O-methoxy ethyl (cMOE) and 2'-O-Ethyl (cEt) modified DNAs.

Examples of modified and chemically-modified nucleotide monomers include 2'-amino nucleotides, 2'-O-amino nucleotides, 2'-C-allyl nucleotides, and 2'-O-allyl nucleotides.

Examples of modified and chemically-modified nucleotide monomers include $N^6$-methyladenosine nucleotides.

Examples of modified and chemically-modified nucleotide monomers include nucleotide monomers with modified bases 5-(3-amino)propyluridine, 5-(2-mercapto)ethyluridine, 5-bromouridine; 8-bromoguanosine, or 7-deazaadenosine.

Examples of modified and chemically-modified nucleotide monomers include 2'-O-aminopropyl substituted nucleotides.

Examples of modified and chemically-modified nucleotide monomers include replacing the 2'-OH group of a nucleotide with a 2'-R, a 2'-OR, a 2'-halogen, a 2'-SR, or a 2'-amino, where R can be H, alkyl, alkenyl, or alkynyl.

Some further examples of modified nucleotides are given in Saenger, Principles of Nucleic Acid Structure, Springer-Verlag, 1984.

Any of the example base modifications described above can be combined with additional modifications of nucleoside or nucleotide structure, including sugar modifications and linkage modifications. Certain modified or chemically-modified nucleotide monomers may be found in nature.

Preferred nucleotide modifications include $N^1$-methylpseudouridine and 5-methoxyuridine.

5' Capping Structure

A Cap structure on the 5'-end of mRNAs, which is present in all eukaryotic organisms (and some viruses) is important for stabilizing mRNAs in vivo. Naturally occurring Cap structures comprise a ribo-guanosine residue that is methylated at position $N^7$ of the guanine base. This 7-methylguanosine ($m^7G$) is linked via a 5'- to 5'-triphosphate chain at the 5'-end of the mRNA molecule. The presence of the $m^7Gppp$ fragment on the 5'-end is essential for mRNA maturation as it protects the mRNAs from degradation by exonucleases, facilitates transport of mRNAs from the nucleus to the cytoplasm and plays a key role in assembly of the translation initiation complex (Cell 9:645-653, (1976); Nature 266:235, (1977); Federation of Experimental Biologists Society Letter 96:1-11, (1978); Cell 40:223-24, (1985); Prog. Nuc. Acid Res. 35:173-207, (1988); Ann. Rev. Biochem. 68:913-963, (1999); and J Biol. Chem. 274: 30337-3040, (1999)).

Only those mRNAs that carry the Cap structure are active in Cap dependent translation; "decapitation" of mRNA results in an almost complete loss of their template activity for protein synthesis (Nature, 255:33-37, (1975); J. Biol. Chem., vol. 253:5228-5231, (1978); and Proc. Natl. Acad. Sci. USA, 72:1189-1193, (1975)).

Another element of eukaryotic mRNA is the presence of 2'-O-methyl nucleoside residues at transcript position 1 (Cap 1), and in some cases, at transcript positions 1 and 2 (Cap 2). The 2'-O-methylation of mRNA provides higher efficacy of mRNA translation in vivo (Proc. Natl. Acad. Sci. USA, 77:3952-3956 (1980)) and further improves nuclease stability of the 5'-capped mRNA. The mRNA with Cap 1 (and Cap 2) is a distinctive mark that allows cells to recognize the bona fide mRNA 5' end, and in some instances, to discriminate against transcripts emanating from infectious genetic elements (Nucleic Acid Research 43: 482-492 (2015)).

Some examples of 5' cap structures and methods for preparing mRNAs comprising the same are given in WO2015/051169A2, WO/2015/061491, US 2018/0273576, and U.S. Pat. Nos. 8,093,367, 8,304,529, and 10,487,105. In some embodiments, the 5' cap is $m^7GpppAmpG$, which is known in the art. In some embodiments, the 5' cap is $m^7GpppG$ or $m^7GpppGm$, which are known in the art. Structural formulas for embodiments of 5' cap structures are provided below.

In some embodiments, an mRNA described herein comprises a 5' cap having the structure of Formula (Cap I).

(Cap I)

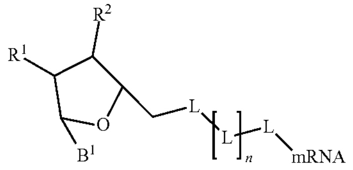

wherein $B^1$ is a natural or modified nucleobase; $R^1$ and $R^2$ are each independently selected from a halogen, OH, and $OCH_3$; each L is independently selected from the group consisting of phosphate, phophorothioate, and boranophosphate wherein each L is linked by diester bonds; n is 0 or 1; and mRNA represents an mRNA of the present disclosure linked at its 5' end. In some embodiments $B^1$ is G, $m^7G$, or A. In some embodiments, n is 0. In some embodiments, n is 1. In some embodiments, $B^1$ is A or $m^6A$ and $R^1$ is $OCH_3$; wherein G is guanine, $m^7G$ is 7-methylguanine, A is adenine, and $m^6A$ is $N^6$-methyladenine.

In some embodiments, an mRNA described herein comprises a 5' cap having the structure of Formula (Cap II).

(Cap II)

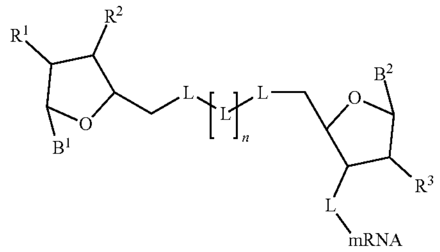

wherein $B^1$ and $B^2$ are each independently a natural or modified nucleobase; $R^1$, $R^2$, and $R^3$ are each independently selected from a halogen, OH, and $OCH_3$; each L is independently selected from the group consisting of phosphate, phophorothioate, and boranophosphate wherein each L is linked by diester bonds; mRNA represents an mRNA of the present disclosure linked at its 5' end; and n is 0 or 1. In some embodiments, at least one of $R^1$, $R^2$, and $R^3$ is OH. In some embodiments $B^1$ is G, $m^7G$, or A. In some embodiments, n is 0. In some embodiments, n is 1. In some embodiments, $B^1$ is A or $m^6A$ and $R^1$ is $OCH_3$; wherein G is guanine, $m^7G$ is 7-methylguanine, A is adenine, and $m^6A$ is $N^6$-methyladenine.

In some embodiments, an mRNA described herein comprises a 5' cap having the structure of Formula (Cap III).

(Cap III)

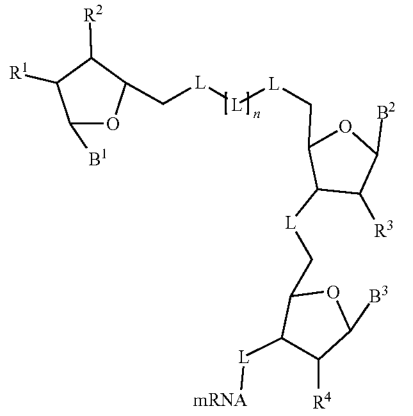

wherein $B^1$, $B^2$, and $B^3$ are each independently a natural or modified nucleobase; $R^1$, $R^2$, $R^3$, and $R^4$ are each independently selected from a halogen, OH, and $OCH_3$; each L is independently selected from the group consisting of phosphate, phosphorothioate, and boranophosphate wherein each L is linked by diester bonds; mRNA represents an mRNA of the present disclosure linked at its 5' end; n is 0 or 1. In some embodiments, at least one of $R^1$, $R^2$, $R^3$, and $R^4$ is OH. In some embodiments $B^1$ is G, $m^7G$, or A. In some embodiments, $B^1$ is A or $m^6A$ and $R^1$ is $OCH_3$; wherein G is guanine, $m^7G$ is 7-methylguanine, A is adenine, and $m^6A$ is $N^6$-methyladenine. In some embodiments, n is 1.

In some embodiments, an mRNA described herein comprises a $m^7GpppG$ 5' cap analog having the structure of Formula (Cap IV).

(Cap IV)

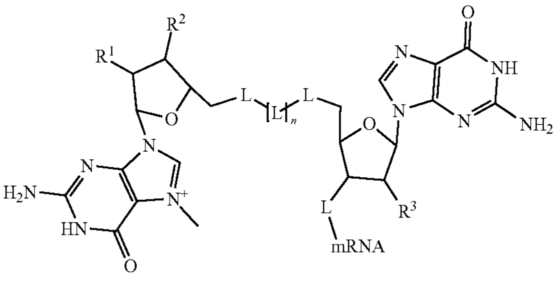

wherein, $R^1$, $R^2$, and $R^3$ are each independently selected from a halogen, OH, and $OCH_3$; each L is independently selected from the group consisting of phosphate, phosphorothioate, and boranophosphate wherein each L is linked by diester bonds; mRNA represents an mRNA of the present disclosure linked at its 5' end; and n is 0 or 1. In some embodiments, at least one of $R^1$, $R^2$, and $R^3$ is OH. In some embodiments, the 5' cap is $m^7GpppG$ wherein $R^1$, $R^2$, and $R^3$ are each OH, n is 1, and each L is a phosphate. In some embodiments, n is 1. In some embodiments, the 5' cap is m7GpppGm, wherein $R^1$ and $R^2$ are each OH, $R^3$ is $OCH_3$, each L is a phosphate, mRNA is a CFTR mRNA of the present disclosure linked at its 5' end, and n is 1.

In some embodiments, an mRNA described herein comprises a $m^7GpppAmpG$ 5' cap analog having the structure of Formula (Cap V).

(Cap V)

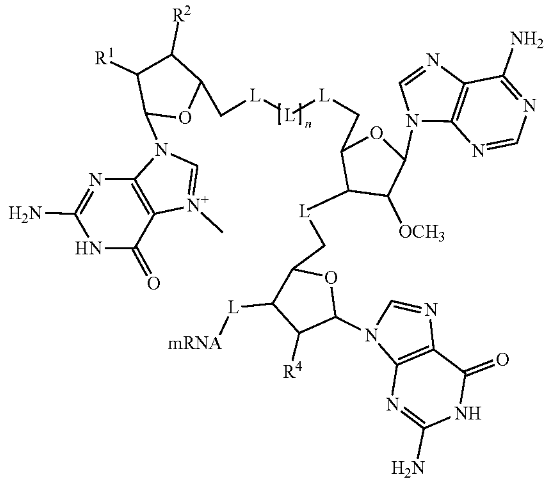

wherein, $R^1$, $R^2$, and $R^4$ are each independently selected from a halogen, OH, and $OCH_3$; each L is independently selected from the group consisting of a phosphate, phosphorothioate, and boranophosphate wherein each L is linked by diester bonds; mRNA represents an mRNA of the present disclosure linked at its 5' end; and n is 0 or 1. In some embodiments, at least one of $R^1$, $R^2$, and $R^4$ is OH. In some embodiments, the compound of Formula Cap Vis $m^7GpppAmpG$, wherein $R^1$, $R^2$, and $R^4$ are each OH, n is 1, and each L is a phosphate. In some embodiments, n is 1.

3' Tail

Polyadenylation is the addition of a poly-A tail, a chain of adenine nucleotides usually about 100-120 monomers in length, to an mRNA. In eukaryotes, polyadenylation is part of the process that produces mature mRNA for translation and begins as the transcription of a gene terminates. The 3'-most segment of a newly made pre-mRNA is first cleaved off by a set of proteins; these proteins then synthesize the poly-A tail at the 3' end. The poly-A tail is important for the nuclear export, translation, and stability of mRNA. The tail is shortened over time, and, when it is short enough, the mRNA is enzymatically degraded. However, in a few cell types, mRNAs with short poly-A tails are stored for later activation by re-polyadenylation in the cytosol.

Poly-A tails can be added using a variety of methods known in the art, e.g., using poly-A polymerase to add tails to synthetic or in vitro transcribed RNA. Other methods include the use of a transcription vector to encode poly-A tails or the use of a ligase (e.g., via splint ligation using a T4 RNA ligase and/or T4 DNA ligase), wherein poly-A may be ligated to the 3' end of a RNA. In some embodiments, a combination of any of the above methods is utilized.

In some embodiments, the mRNA sequence encoding CFTR comprises a tail region, which can serve to protect the mRNA from exonuclease degradation. In some embodiments, the tail region can be a poly-A tail. The tail region may be a 3' poly-A and/or 3' poly-C region. Preferably, the tail region is a 3' poly-A tail. As used herein a "3' poly-A tail" is a polymer of sequential adenine nucleotides that can range in size from, for example: 10 to 250 sequential adenine nucleotides; 60-125 sequential adenine nucleotides, 90-125 sequential adenine nucleotides, 95-125 sequential adenine nucleotides, 95-121 sequential adenine nucleotides, 100 to 121 sequential adenine nucleotides, 110-121 sequential adenine nucleotides; 112-121 sequential adenine nucleotides; 114-121 sequential adenine nucleotides; or 115 to 121 sequential adenine nucleotides. Preferably, a 3' poly-A tail as described herein comprise 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, or 125 sequential adenine nucleotides.

In some embodiments, an mRNA sequence comprises a 3' poly-A tail structure. In some embodiments, the length of the poly-A tail can be at least about 5, 10, 15, 20, 25, 30, 35, 40, 45, 50, 100, 200, or 300 nucleotides. In some embodiments, a 3' poly-A tail contains about 5 to 300 adenosine nucleotides (e.g., about 30 to 250 adenosine nucleotides, about 60 to 220 adenosine nucleotides, about 80 to 200 adenosine nucleotides, about 90 to about 150 adenosine nucleotides, or about 100 to about 120 adenosine nucleotides). In an embodiment, the 3' poly-A tail is about 100 nucleotides in length. In another embodiment, the 3' poly-A tail is about 115 nucleotides in length. In another embodiment, the 3' poly-A tail is about 250 nucleotides in length.

In some embodiments, the 3' poly-A tail comprises one or more UNA monomers. In some embodiments, the 3' poly-A tail contains 2, 3, 4, 5, 10, 15, 20, or more UNA monomers. In an embodiment, the 3' poly-A tail contains 2 UNA monomers. In a further embodiment, the 3' poly-A tail contains 2 UNA monomers which are found consecutively, i.e., contiguous to each other in the 3' poly-A tail. Synthetic methods and example constructs for UNA-containing poly-A tails are described in WO 2016/070166, the contents of which are incorporated herein by reference.

In an embodiment, the 3' poly-A tail comprises a sequence of Poly-A100 or Poly-A120, which consist of 100 or 120 adenosine nucleotides, In some embodiments, the mRNA sequence comprises a 3' poly-C tail structure. In some embodiments, the length of the poly-C tail can be at least about 5, 10, 15, 20, 25, 30, 35, 40, 45, 50, 100, 200, or 300 nucleotides. In some embodiments, a 3' poly-C tail contains about 5 to 300 cytosine nucleotides (e.g., about 30 to 250 cytosine nucleotides, about 60 to 220 cytosine nucleotides, about 80 to about 200 cytosine nucleotides, about 90 to 150 cytosine nucleotides, or about 100 to about 120 cytosine nucleotides). In an embodiment, the 3' poly-C tail is about 100 nucleotides in length. In another embodiment, the 3' poly-C tail is about 115 nucleotides in length. The poly-C tail may be added to the poly-A tail or may substitute the poly-A tail. The poly-C tail may be added to the 5' end of the poly-A tail or the 3' end of the poly-A tail.

In some embodiments, the length of the poly-A and/or poly-C tail is adjusted to control the stability of a modified mRNA of the disclosure and, thus, the transcription of protein. For example, since the length of the poly-A tail can influence the half-life of an mRNA sequence, the length of the poly-A tail can be adjusted to modify the level of resistance of the mRNA to nucleases and thereby control the time course of polynucleotide expression and/or polypeptide production in a target cell.

5' and 3' Untranslated Regions (UTRs)

In molecular genetics, an untranslated region (UTR) refers to either of two sections, one on each side of a coding sequence on a strand of mRNA. If it is found on the 5' side, it is called the 5' UTR (or leader sequence), or if it is found on the 3' side, it is called the 3' UTR (or trailer sequence). As a mRNA is translated into a protein in vivo, several regions of the mRNA are usually not translated, including the 5' and 3' UTRs. In some embodiments, an mRNA described herein further comprises a 5' untranslated region (UTR) sequence. The 5' UTR is upstream from the coding sequence. In some cases, within the 5' UTR is a sequence that is recognized by the ribosome which allows the ribosome to bind and initiate translation (such as an internal ribosome entry site (IRES). Eukaryotic mRNA typically recruits a ribosome by way of a 5' cap, but may alternatively or additionally include an IRES. In contrast, the 3' UTR is typically found immediately following the translation stop codon of the coding region. The 3' UTR can play an important role in translation termination as well as post-transcriptional modification. Thus, as is understood in the art, the 5' and/or 3' UTR may affect an mRNA's stability or efficiency of translation. The 5' UTR may be derived from an mRNA molecule known in the art as relatively stable (e.g., histone, tubulin, globin, glyceraldehyde 1-phosphate dehydrogenase (GAPDH), actin, or citric acid cycle enzymes) to increase the stability of the translatable oligomer. In other embodiments, a 5' UTR sequence may include a partial sequence of a cytomegalovirus (CMV) immediate-early 1 (IE1) gene.

In some embodiments, the mRNA sequence may comprise a 5' UTR that is at least about 25, 50, 75, 100, 125, 150, 175, 200, 300, 400, or 500 nucleotides. In some embodiments, a 5' UTR contains about 50 to 300 nucleotides (e.g., about 75 to 250 nucleotides, about 100 to 200 nucleotides, about 120 to 150 nucleotides, or about 135 nucleotides). In an embodiment, the 5' UTR is about 127 nucleotides in length.

Preferably, the 5' UTR comprises a sequence selected from the 5' UTRs of human IL-6, alanine aminotransferase 1, human apolipoprotein E, human fibrinogen alpha chain, human transthyretin, human haptoglobin, human alpha-1-antichymotrypsin, human antithrombin, human alpha-1-antitrypsin, human albumin, human beta globin, human complement C3, human complement C5, SynK (thylakoid potassium channel protein derived from the cyanobacteria, *Synechocystis* sp.), mouse beta globin, mouse albumin, and a tobacco etch virus, or fragments of any of the foregoing. Preferably, the 5' UTR is derived from a tobacco etch virus (TEV). Preferably, an mRNA described herein comprises a 5' UTR sequence that is derived from a gene expressed by *Arabidopsis thaliana*. Preferably, the 5' UTR sequence of a gene expressed by *Arabidopsis thaliana* is AT1G58420. Examples of 5' UTRs and 3' UTRs are described in WO 2018/222890, the contents of which are herein incorporated by reference. Preferred 5' UTR sequences comprise a sequence selected from SEQ ID NOs: 106-125.

In some embodiments, the 5' UTR sequence comprises SEQ ID NO: 106 (TEV). In some embodiments, the 5' UTR sequence comprises SEQ ID NO: 107 (AT1G58420).

In some embodiments, the 3' UTR comprises a sequence selected from the 3' UTRs of alanine aminotransferase 1, human apolipoprotein E, human fibrinogen alpha chain, human haptoglobin, human antithrombin, human alpha globin, human beta globin, human complement C3, human growth factor, human hepcidin, MALAT-1, mouse beta globin, mouse albumin, and Xenopus beta globin, or fragments of any of the foregoing. In some embodiments, the 3' UTR is derived from Xenopus beta globin. Examples of 3' UTR sequences include SEQ ID NOs: 126-145. In some embodiments, the 3' UTR sequence comprises SEQ ID NO: 126 (XBG).

In certain embodiments, the mRNA sequence encoding CFTR comprises a 5' UTR sequence of SEQ ID NOs: 106-125 and a 3' UTR sequence selected from SEQ ID NOs: 126-145. In some embodiments, the 5' UTR sequence comprises SEQ ID NO: 106 and the 3' UTR sequence comprises SEQ ID NO: 126.

Triple Stop Codon

In some embodiments, the translatable oligomer or polymer encoding CFTR may comprise a sequence immediately downstream of a coding region (i.e., ORF) that creates a triple stop codon. A triple stop codon is a sequence of three consecutive stop codons. The triple stop codon can ensure total insulation of an expression cassette and may be incorporated to enhance the efficiency of translation. In some embodiments, the mRNA may comprise the sequence UAG, UGA, or UAA immediately downstream of an ORF described herein. The triple combination can be three of the same codons, three different codons, or any other permutation of the three stop codons.

Translation Enhancers and Kozak Sequences

For translation initiation, proper interactions between ribosomes and mRNAs must be established to determine the exact position of the translation initiation region. However, ribosomes also must dissociate from the translation initiation region to slide toward the downstream sequence during mRNA translation. Translation enhancers upstream from initiation sequences of mRNAs enhance the yields of protein biosynthesis. Several studies have investigated the effects of translation enhancers. In some embodiments, an mRNA described herein comprises a translation enhancer sequence. These translation enhancer sequences enhance the translation efficiency of a mRNA described herein and thereby provide increased production of the protein encoded by the mRNA. The translation enhancer region may be located in the 5' or 3' UTR of an mRNA sequence. Examples of translation enhancer regions include naturally occurring enhancer regions from the TEV 5' UTR and the Xenopus beta-globin 3' UTR. Example 5' UTR enhancer sequences include but are not limited to those derived from mRNAs encoding human heat shock proteins (HSP) including HSP70-P2, HSP70-M1 HSP72-M2, HSP17.9 and HSP70-P1.

In some embodiments, the mRNA sequence encoding CFTR may comprise a Kozak sequence. As is understood in the art, a Kozak sequence is a short consensus sequence centered around the translational initiation site of eukaryotic mRNAs that allows for efficient initiation of translation of the mRNA. See, for example, Kozak, Marilyn (1988) Mol. and Cell Biol, 8:2737-2744; Kozak, Marilyn (1991) J. Biol. Chem, 266: 19867-19870; Kozak, Marilyn (1990) Proc Natl. Acad. Sci. USA, 87:8301-8305; and Kozak, Marilyn (1989) J. Cell Biol, 108:229-241; and the references cited therein. It ensures that a protein is correctly translated from the genetic message, mediating ribosome assembly and translation initiation. The ribosomal translation machinery recognizes the AUG initiation codon in the context of the Kozak sequence.

In some embodiments, the translation initiation site (e.g., a Kozak sequence) is inserted upstream of the coding sequence for CFTR. In some embodiments, the translation initiation site is inserted downstream of a 5' UTR. In certain embodiments, the translation initiation site is inserted upstream of the coding sequence for CFTR and downstream of a 5' UTR.

As is understood in the art, the length of the Kozak sequence may vary. Generally, increasing the length of the leader sequence enhances translation. In some embodiments, the Kozak sequence is immediately downstream of a 5' UTR and immediately upstream of the coding sequence for CFTR. In this aspect, Table 1 lists mRNA constructs exemplified herein.

TABLE 1

(mRNA Constructs)

| mRNA Construct No. | Cap | 5'UTR | Kozak | CFTR Protein Encoded | 3'UTR | 3' Poly A Tail | mRNA Construct SEQ ID NO: |
|---|---|---|---|---|---|---|---|
| 139 | Cap1 | TEV | Yes | SEQ ID NO: 93 | XBG | Yes | 47 |
| 140 | Cap1 | TEV | Yes | SEQ ID NO: 93 | XBG | Yes | 48 |
| 141 | Cap1 | TEV | Yes | SEQ ID NO: 93 | XBG | Yes | 49 |
| 142 | Cap1 | TEV | Yes | SEQ ID NO: 93 | XBG | Yes | 50 |
| 143 | Cap1 | TEV | Yes | SEQ ID NO: 93 | XBG | Yes | 51 |
| 144 | Cap1 | TEV | Yes | SEQ ID NO: 93 | XBG | Yes | 52 |
| 145 | Cap1 | TEV | Yes | SEQ ID NO: 93 | XBG | Yes | 53 |
| 146 | Cap1 | TEV | Yes | SEQ ID NO: 93 | XBG | Yes | 54 |
| 147 | Cap1 | TEV | No | SEQ ID NO: 93 | XBG | Yes | 55 |
| 148 | Cap1 | TEV | No | SEQ ID NO: 93 | XBG | Yes | 56 |
| 149 | Cap1 | TEV | No | SEQ ID NO: 93 | XBG | Yes | 57 |
| 150 | Cap1 | TEV | Yes | SEQ ID NO: 93 | XBG | Yes | 58 |
| 151 | Cap1 | TEV | Yes | SEQ ID NO: 93 | XBG | Yes | 59 |
| 152 | Cap1 | TEV | Yes | SEQ ID NO: 93 | XBG | Yes | 60 |
| 153 | Cap1 | TEV | Yes | SEQ ID NO: 93 | XBG | Yes | 61 |
| 154 | Cap1 | TEV | Yes | SEQ ID NO: 93 | XBG | Yes | 62 |
| 155 | Cap1 | TEV | Yes | SEQ ID NO: 93 | XBG | Yes | 63 |
| 156 | Cap1 | TEV | Yes | SEQ ID NO: 93 | XBG | Yes | 64 |
| 157 | Cap1 | TEV | Yes | SEQ ID NO: 93 | XBG | Yes | 65 |
| 158 | Cap1 | TEV | Yes | SEQ ID NO: 93 | XBG | Yes | 66 |
| 159 | Cap1 | TEV | Yes | SEQ ID NO: 93 | XBG | Yes | 67 |
| 160 | Cap1 | TEV | Yes | SEQ ID NO: 93 | XBG | Yes | 68 |
| 161 | Cap1 | TEV | Yes | SEQ ID NO: 93 | XBG | Yes | 69 |
| 162 | Cap1 | TEV | Yes | SEQ ID NO: 93 | XBG | Yes | 70 |
| 163 | Cap1 | TEV | Yes | SEQ ID NO: 93 | XBG | Yes | 71 |
| 164 | Cap1 | TEV | Yes | SEQ ID NO: 93 | XBG | Yes | 72 |
| 165 | Cap1 | TEV | Yes | SEQ ID NO: 93 | XBG | Yes | 73 |
| 166 | Cap1 | TEV | Yes | SEQ ID NO: 93 | XBG | Yes | 74 |

TABLE 1-continued (mRNA Constructs)

| mRNA Construct No. | Cap | 5'UTR | Kozak | CFTR Protein Encoded | 3'UTR | 3' Poly A Tail | mRNA Construct SEQ ID NO: |
|---|---|---|---|---|---|---|---|
| 167 | Cap1 | TEV | Yes | SEQ ID NO: 93 | XBG | Yes | 75 |
| 168 | Cap1 | TEV | Yes | SEQ ID NO: 93 | XBG | Yes | 76 |
| 169 | Cap1 | TEV | Yes | SEQ ID NO: 93 | XBG | Yes | 77 |
| 170 | Cap1 | TEV | Yes | SEQ ID NO: 93 | XBG | Yes | 78 |
| 171 | Cap1 | TEV | Yes | SEQ ID NO: 93 | XBG | Yes | 79 |
| 172 | Cap1 | TEV | Yes | SEQ ID NO: 93 | XBG | Yes | 80 |
| 173 | Cap1 | TEV | Yes | SEQ ID NO: 93 | XBG | Yes | 81 |
| 174 | Cap1 | TEV | Yes | SEQ ID NO: 93 | XBG | Yes | 82 |
| 175 | Cap1 | TEV | Yes | SEQ ID NO: 93 | XBG | Yes | 83 |
| 176 | Cap1 | TEV | Yes | SEQ ID NO: 93 | XBG | Yes | 84 |
| 177 | Cap1 | TEV | Yes | SEQ ID NO: 93 | XBG | Yes | 85 |
| 178 | Cap1 | TEV | Yes | SEQ ID NO: 93 | XBG | Yes | 86 |
| 179 | Cap1 | TEV | Yes | SEQ ID NO: 93 | XBG | Yes | 87 |
| 180 | Cap1 | TEV | Yes | SEQ ID NO: 93 | XBG | Yes | 88 |
| 181 | Cap1 | TEV | Yes | SEQ ID NO: 93 | XBG | Yes | 89 |
| 182 | Cap1 | TEV | Yes | SEQ ID NO: 93 | XBG | Yes | 90 |
| 183 | Cap1 | TEV | Yes | SEQ ID NO: 93 | XBG | Yes | 91 |
| 184 | Cap1 | TEV | Yes | SEQ ID NO: 93 | XBG | Yes | 92 |
| 766 | Cap1 | TEV | Yes | SEQ ID NO: 93 with modifications | XBG | Yes | 48 |
| 1831 | Cap1 | TEV | Yes | SEQ ID NO: 99 | XBG | Yes | 49 |
| 1833 | Cap1 | TEV | Yes | SEQ ID NO: 99 | XBG | Yes | 51 |
| 1835 | Cap1 | TEV | Yes | SEQ ID NO: 99 | XBG | Yes | 53 |
| 2093 | Cap1 | TEV | Yes | SEQ ID NO: 99 | XBG | Yes | 66 |
| 2095 | Cap1 | TEV | Yes | SEQ ID NO: 99 | XBG | Yes | 68 |
| 2096 | Cap1 | TEV | Yes | SEQ ID NO: 99 | XBG | Yes | 69 |
| 2099 | Cap1 | TEV | Yes | SEQ ID NO: 99 | XBG | Yes | 72 |

Lipid-Based Formulations

Therapies based on the intracellular delivery of nucleic acids to target cells face both extracellular and intracellular barriers. Indeed, naked nucleic acid materials cannot be easily systemically administered due to their toxicity, low stability in serum, rapid renal clearance, reduced uptake by target cells, phagocyte uptake and their ability in activating the immune response, all features that preclude their clinical development. When exogenous nucleic acid material (e.g., mRNA) enters the human biological system, it is recognized by the reticuloendothelial system (RES) as foreign pathogens and cleared from blood circulation before having the chance to encounter target cells within or outside the vascular system. It has been reported that the half-life of naked nucleic acid in the blood stream is around several minutes (Kawabata K, Takakura Y, Hashida MPharm Res. 1995 June; 12(6):825-30). Chemical modification and a proper delivery method can reduce uptake by the RES and protect nucleic acids from degradation by ubiquitous nucleases, which increase stability and efficacy of nucleic acid-based therapies. In addition, RNAs or DNAs are anionic hydrophilic polymers that are not favorable for uptake by cells, which are also anionic at the surface. The success of nucleic acid-based therapies thus depends largely on the development of vehicles or vectors that can efficiently and effectively deliver genetic material to target cells and obtain sufficient levels of expression in vivo with minimal toxicity.

Moreover, upon internalization into a target cell, nucleic acid delivery vectors are challenged by intracellular barriers, including endosome entrapment, lysosomal degradation, nucleic acid unpacking from vectors, translocation across the nuclear membrane (for DNA), and release at the cytoplasm (for RNA). Successful nucleic acid-based therapy thus depends upon the ability of the vector to deliver the nucleic acids to the target sites inside of the cells in order to obtain sufficient levels of a desired activity such as expression of a gene.

While several gene therapies have been able to successfully utilize a viral delivery vector (e.g., AAV), lipid-based formulations have been increasingly recognized as one of the most promising delivery systems for RNA and other nucleic acid compounds due to their biocompatibility and their ease of large-scale production. One of the most significant advances in lipid-based nucleic acid therapies happened in August 2018 when Patisiran (ALN-TTR02) was the first siRNA therapeutic approved by the Food and Drug Administration (FDA) and by the European Commission (EC). ALN-TTR02 is an siRNA formulation based upon the so-called Stable Nucleic Acid Lipid Particle (SNALP) transfecting technology. Despite the success of Patisiran, the delivery of nucleic acid therapeutics, including mRNA, via lipid formulations is still undergoing development.

Some art-recognized lipid-formulated delivery vehicles for nucleic acid therapeutics include, according to various embodiments, polymer based carriers, such as polyethyleneimine (PEI), lipid nanoparticles and liposomes, nanoliposomes, ceramide-containing nanoliposomes, multivesicular liposomes, proteoliposomes, both natural and synthetically-derived exosomes, natural, synthetic and semi-synthetic lamellar bodies, nanoparticulates, micelles, and emulsions. These lipid formulations can vary in their structure and composition, and as can be expected in a rapidly evolving field, several different terms have been used in the art to describe a single type of delivery vehicle. At the same time, the terms for lipid formulations have varied as to their intended meaning throughout the scientific literature, and this inconsistent use has caused confusion as to the exact meaning of several terms for lipid formulations. Among the several potential lipid formulations, liposomes, cationic liposomes, and lipid nanoparticles are specifically described in detail and defined herein for the purposes of the present disclosure.

Liposomes

Conventional liposomes are vesicles that consist of at least one bilayer and an internal aqueous compartment. Bilayer membranes of liposomes are typically formed by amphiphilic molecules, such as lipids of synthetic or natural origin that comprise spatially separated hydrophilic and hydrophobic domains (Lasic, Trends Biotechnol., 16: 307-

321, 1998). Bilayer membranes of the liposomes can also be formed by amphiphilic polymers and surfactants (e.g., polymerosomes, niosomes, etc.). They generally present as spherical vesicles and can range in size from 20 nm to a few microns. Liposomal formulations can be prepared as a colloidal dispersion or they can be lyophilized to reduce stability risks and to improve the shelf-life for liposome-based drugs. Methods of preparing liposomal compositions are known in the art and are within the skill of an ordinary artisan.

Liposomes that have only one bilayer are referred to as being unilamellar, and those having more than one bilayer are referred to as multilamellar. The most common types of liposomes are small unilamellar vesicles (SUV), large unilamellar vesicles (LUV), and multilamellar vesicles (MLV). In contrast to liposomes, lysosomes, micelles, and reversed micelles are composed of monolayers of lipids. Generally, a liposome is thought of as having a single interior compartment, however some formulations can be multivesicular liposomes (MVL), which consist of numerous discontinuous internal aqueous compartments separated by several non-concentric lipid bilayers.

Liposomes have long been perceived as drug delivery vehicles because of their superior biocompatibility, given that liposomes are basically analogs of biological membranes, and can be prepared from both natural and synthetic phospholipids (Int. J. Nanomedicine. 2014; 9:1833-1843). In their use as drug delivery vehicles, because a liposome has an aqueous solution core surrounded by ahydrophobic membrane, hydrophilic solutes dissolved in the core cannot readily pass through the bilayer, and hydrophobic compounds will associate with the bilayer. Thus, a liposome can be loaded with hydrophobic and/or hydrophilic molecules. When a liposome is used to carry a nucleic acid such as RNA, the nucleic acid is contained within the liposomal compartment in an aqueous phase.

Cationic Liposomes

Liposomes can be composed of cationic, anionic, and/or neutral lipids. As an important subclass of liposomes, cationic liposomes are liposomes that are made in whole or part from positively charged lipids, or more specifically a lipid that comprises both a cationic group and a lipophilic portion. In addition to the general characteristics profiled above for liposomes, the positively charged moieties of cationic lipids used in cationic liposomes provide several advantages and some unique structural features. For example, the lipophilic portion of the cationic lipid is hydrophobic and thus will direct itself away from the aqueous interior of the liposome and associate with other nonpolar and hydrophobic species. Conversely, the cationic moiety will associate with aqueous media and more importantly with polar molecules and species with which it can complex in the aqueous interior of the cationic liposome. For these reasons, cationic liposomes are increasingly being researched for use in gene therapy due to their favorability towards negatively charged nucleic acids via electrostatic interactions, resulting in complexes that offer biocompatibility, low toxicity, and the possibility of the large-scale production required for in vivo clinical applications. Cationic lipids suitable for use in cationic liposomes are listed hereinbelow.

Lipid Nanoparticles

In contrast to liposomes and cationic liposomes, lipid nanoparticles (LNP) have a structure that includes a single monolayer or bilayer of lipids that encapsulates a compound in a solid phase. Thus, unlike liposomes, lipid nanoparticles do not have an aqueous phase or other liquid phase in its interior, but rather the lipids from the bilayer or monolayer shell are directly complexed to the internal compound thereby encapsulating it in a solid core. Lipid nanoparticles are typically spherical vesicles having a relatively uniform dispersion of shape and size. While sources vary on what size qualifies a lipid particle as being a nanoparticle, there is some overlap in agreement that a lipid nanoparticle can have a diameter in the range of from 10 nm to 1000 nm. However, more commonly they are considered to be smaller than 120 nm or even 100 nm.

For lipid nanoparticle nucleic acid delivery systems, the lipid shell can be formulated to include an ionizable cationic lipid which can complex to and associate with the negatively charged backbone of the nucleic acid core. Ionizable cationic lipids with apparent pKa values below about 7 have the benefit of providing a cationic lipid for complexing with the nucleic acid's negatively charged backbone and loading into the lipid nanoparticle at pH values below the pKa of the ionizable lipid where it is positively charged. Then, at physiological pH values, the lipid nanoparticle can adopt a relatively neutral exterior allowing for a significant increase in the circulation half-lives of the particles following i.v. administration. In the context of nucleic acid delivery, lipid nanoparticles offer many advantages over other lipid-based nucleic acid delivery systems including high nucleic acid encapsulation efficiency, potent transfection, improved penetration into tissues to deliver therapeutics, and low levels of cytotoxicity and immunogenicity.

Prior to the development of lipid nanoparticle delivery systems for nucleic acids, cationic lipids were widely studied as synthetic materials for delivery of nucleic acid medicines. In these early efforts, after mixing together at physiological pH, nucleic acids were condensed by cationic lipids to form lipid-nucleic acid complexes known as lipoplexes. However, lipoplexes proved to be unstable and characterized by broad size distributions ranging from the submicron scale to a few microns. Lipoplexes, such as the Lipofectamine® reagent, have found considerable utility for in vitro transfection. However, these first-generation lipoplexes have not proven useful in vivo. The large particle size and positive charge (imparted by the cationic lipid) result in rapid plasma clearance, hemolytic and other toxicities, as well as immune system activation.

Lipid-mRNA Formulations

An mRNA as disclosed herein or a pharmaceutically acceptable salt thereof can be incorporated into a lipid formulation (i.e., a lipid-based delivery vehicle).

In the context of the present disclosure, a lipid-based delivery vehicle typically serves to transport a desired mRNA to a target cell or tissue. The lipid-based delivery vehicle can be any suitable lipid-based delivery vehicle known in the art. In some embodiments, the lipid-based delivery vehicle is a liposome, a cationic liposome, or a lipid nanoparticle containing an mRNA of the present disclosure. In some embodiments, the lipid-based delivery vehicle comprises a nanoparticle or a bilayer of lipid molecules and an mRNA of the present disclosure. In some embodiments, the lipid bilayer preferably further comprises a neutral lipid or a polymer. In some embodiments, the lipid formulation preferably comprises a liquid medium. In some embodiments, the formulation preferably further encapsulates a nucleic acid. In some embodiments, the lipid formulation preferably further comprises a nucleic acid and a neutral lipid or a polymer. In some embodiments, the lipid formulation preferably encapsulates the nucleic acid.

The description provides lipid formulations comprising one or more therapeutic mRNA molecules encapsulated within the lipid formulation. In some embodiments, the lipid formulation comprises liposomes. In some embodiments, the lipid formulation comprises cationic liposomes. In some embodiments, the lipid formulation comprises lipid nanoparticles.

In some embodiments, the mRNA is fully encapsulated within the lipid portion of the lipid formulation such that the mRNA in the lipid formulation is resistant in aqueous solution to nuclease degradation. In other embodiments, the lipid formulations described herein are substantially non-toxic to mammals such as humans.

The lipid formulations of the disclosure also typically have a total lipid:RNA ratio (mass/mass ratio) of from about 1:1 to about 100:1, from about 1:1 to about 50:1, from about 2:1 to about 45:1, from about 3:1 to about 40:1, from about 5:1 to about 38:1, or from about 6:1 to about 40:1, or from about 7:1 to about 35:1, or from about 8:1 to about 30:1; or from about 10:1 to about 25:1; or from about 8:1 to about 12:1; or from about 13:1 to about 17:1; or from about 18:1 to about 24:1; or from about 20:1 to about 30:1. In some preferred embodiments, the total lipid:RNA ratio (mass/mass ratio) is from about 10:1 to about 25:1. The ratio may be any value or subvalue within the recited ranges, including endpoints.

The lipid formulations of the present disclosure typically have a mean diameter of from about 30 nm to about 150 nm, from about 40 nm to about 150 nm, from about 50 nm to about 150 nm, from about 60 nm to about 130 nm, from about 70 nm to about 110 nm, from about 70 nm to about 100 nm, from about 80 nm to about 100 nm, from about 90 nm to about 100 nm, from about 70 to about 90 nm, from about 80 nm to about 90 nm, from about 70 nm to about 80 nm, or about 30 nm, about 35 nm, about 40 nm, about 45 nm, about 50 nm, about 55 nm, about 60 nm, about 65 nm, about 70 nm, about 75 nm, about 80 nm, about 85 nm, about 90 nm, about 95 nm, about 100 nm, about 105 nm, about 110 nm, about 115 nm, about 120 nm, about 125 nm, about 130 nm, about 135 nm, about 140 nm, about 145 nm, or about 150 nm, and are substantially non-toxic. The diameter may be any value or subvalue within the recited ranges, including endpoints. In addition, nucleic acids, when present in the lipid nanoparticles of the present disclosure, are resistant in aqueous solution to degradation with a nuclease.

In preferred embodiments, the lipid formulations comprise an mRNA, a cationic lipid (e.g., one or more cationic lipids or salts thereof described herein), a phospholipid, and a conjugated lipid that inhibits aggregation of the particles (e.g., one or more PEG-lipid conjugates). The lipid formulations can also include cholesterol.

In the nucleic acid-lipid formulations, the mRNA may be fully encapsulated within the lipid portion of the formulation, thereby protecting the nucleic acid from nuclease degradation. In preferred embodiments, a lipid formulation comprising an mRNA is fully encapsulated within the lipid portion of the lipid formulation, thereby protecting the nucleic acid from nuclease degradation. In certain instances, the mRNA in the lipid formulation is not substantially degraded after exposure of the particle to a nuclease at 37° C. for at least 20, 30, 45, or 60 minutes. In certain other instances, the mRNA in the lipid formulation is not substantially degraded after incubation of the formulation in serum at 37° C. for at least 30, 45, or 60 minutes or at least 2, 3, 4, 5, 6, 7, 8, 9, 10, 12, 14, 16, 18, 20, 22, 24, 26, 28, 30, 32, 34, or 36 hours. In other embodiments, the mRNA is complexed with the lipid portion of the formulation.

In the context of nucleic acids, full encapsulation may be determined by performing a membrane-impermeable fluorescent dye exclusion assay, which uses a dye that has enhanced fluorescence when associated with nucleic acid. Encapsulation is determined by adding the dye to a lipid formulation, measuring the resulting fluorescence, and comparing it to the fluorescence observed upon addition of a small amount of nonionic detergent. Detergent-mediated disruption of the lipid layer releases the encapsulated nucleic acid, allowing it to interact with the membrane-impermeable dye. Nucleic acid encapsulation may be calculated as $E=(I_0-I)/I_0$, where I and $I_0$ refer to the fluorescence intensities before and after the addition of detergent.

In other embodiments, the present disclosure provides a nucleic acid-lipid composition comprising a plurality of nucleic acid-liposomes, nucleic acid-cationic liposomes, or nucleic acid-lipid nanoparticles. In some embodiments, the nucleic acid-lipid composition comprises a plurality of mRNA-liposomes. In some embodiments, the nucleic acid-lipid composition comprises a plurality of mRNA-cationic liposomes. In some embodiments, the nucleic acid-lipid composition comprises a plurality of mRNA-lipid nanoparticles.

In some embodiments, the lipid formulations comprise mRNA that is fully encapsulated within the lipid portion of the formulation, such that from about 30% to about 100%, from about 40% to about 100%, from about 50% to about 100%, from about 60% to about 100%, from about 70% to about 100%, from about 80% to about 100%, from about 90% to about 100%, from about 30% to about 95%, from about 40% to about 95%, from about 50% to about 95%, from about 60% to about 95%, from about 70% to about 95%, from about 80% to about 95%, from about 85% to about 95%, from about 90% to about 95%, from about 30% to about 90%, from about 40% to about 90%, from about 50% to about 90%, from about 60% to about 90%, from about 70% to about 90%, from about 80% to about 90%, or at least about 30%, about 35%, about 40%, about 45%, about 50%, about 55%, about 60%, about 65%, about 70%, about 75%, about 80%, about 85%, about 90%, about 91%, about 92%, about 93%, about 94%, about 95%, about 96%, about 97%, about 98%, or about 99% (or any fraction thereof or range therein) of the particles have the mRNA encapsulated therein. The amount may be any value or subvalue within the recited ranges, including endpoints.

Depending on the intended use of the lipid formulation, the proportions of the components can be varied, and the delivery efficiency of a particular formulation can be measured using assays known in the art.

According to some embodiments, the expressible polynucleotides and mRNA constructs described herein are lipid formulated. The lipid formulation is preferably selected from, but not limited to, liposomes, cationic liposomes, and lipid nanoparticles. In one preferred embodiment, a lipid formulation is a cationic liposome or a lipid nanoparticle (LNP) comprising:

(a) an mRNA of the present disclosure,
(b) a cationic lipid,
(c) an aggregation reducing agent (such as polyethylene glycol (PEG) lipid or PEG-modified lipid),
(d) optionally a non-cationic lipid (such as a neutral lipid), and
(e) optionally, a sterol.

In one some embodiments, the cationic lipid is an ionizable cationic lipid. In one embodiment, the lipid nanoparticle formulation consists of (i) at least one cationic lipid; (ii) a helper lipid; (iii) a sterol (e.g., cholesterol); and (iv) a PEG-lipid, in a molar ratio of about 20% to about 40% ionizable cationic lipid: about 25% to about 45% helper lipid: about 25% to about 45% sterol; about 0.5-5% PEG-lipid. Example cationic lipids (including ionizable cationic lipids), helper lipids (e.g., neutral lipids), sterols, and ligand-containing lipids (e.g., PEG-lipids) are described hereinbelow.

Cationic Lipids

The lipid formulation preferably includes a cationic lipid suitable for forming a cationic liposome or lipid nanoparticle. Cationic lipids are widely studied for nucleic acid delivery because they can bind to negatively charged membranes and induce uptake. Generally, cationic lipids are amphiphiles containing a positive hydrophilic head group, two (or more) lipophilic tails, or a steroid portion and a connector between these two domains. Preferably, the cationic lipid carries a net positive charge at about physiological pH. Cationic liposomes have been traditionally the most commonly used non-viral delivery systems for oligonucleotides, including plasmid DNA, antisense oligos, and siRNA/small hairpin RNA-shRNA. Cationic lipids, such as DOTAP, (1,2-dioleoyl-3-trimethylammonium-propane) and DOTMA (N-[1-(2,3-dioleoyloxy)propyl]-N,N,N-trimethyl-ammonium methyl sulfate) can form complexes or lipoplexes with negatively charged nucleic acids by electrostatic interaction, providing high in vitro transfection efficiency.

In the presently disclosed lipid formulations, the cationic lipid may be, for example, N,N-dioleyl-N,N-dimethylammonium chloride (DODAC), N,N-distearyl-N,N-dimethylammonium bromide (DDAB), 1,2-dioleoyltrimethylammoniumpropane chloride (DOTAP) (also known as N-(2,3-dioleoyloxy) propyl)-N,N,N-trimethylammonium chloride and 1,2-Dioleyloxy-3-trimethylaminopropane chloride salt), N-(1-(2,3-dioleyloxy) propyl)-N,N,N-trimethylammonium chloride (DOTMA), N,N-dimethyl-2,3-dioleyloxy) propylamine (DODMA), 1,2-DiLinoleyloxy-N,N-dimethylaminopropane (DLinDMA), 1,2-Dilinolenyloxy-N,N-dimethylaminopropane (DLenDMA), 1,2-di-y-linolenyloxy-N,N-dimethylaminopropane (y-DLenDMA), 1,2-Dilinoleylcarbamoyloxy-3-dimethylaminopropane (DLin-C-DAP), 1,2-Dilinoleyoxy-3-(dimethylamino) acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino) propane (DLin-MPZ), or 3-(N,N-Dilinoleylamino)-1,2-propanediol (DLinAP), 3-(N,N-Dioleylamino)-1,2-propanediol (DOAP), 1,2-Dilinoleyloxo-3-(2-N,N-dimethylamino) ethoxypropane (DLin-EG-DMA), 2,2-Dilinoleyl-4-dimethylaminomethyl-[1,3]-dioxolane (DLin-K-DMA) or analogs thereof, (3aR,5s,6aS)-N,N-dimethyl-2,2-di ((9Z,12Z)-octadeca-9,12-dienyl) tetrahydro-3aH-cyclopenta [d][1,3]dioxol-5-amine, (6Z,9Z,28Z,31Z)-heptatriaconta-6,9,28,31-tetraen-19-yl4-(dimethylamino) butanoate (MC3), 1,1'-(2-(4-(2-((2-(bis (2-hydroxydodecyl) amino) ethyl) (2-hydroxydodecyl) amino) ethyl) piperazin-1-yl) ethylazanediyl) didodecan-2-ol (C12-200), 2,2-dilinoleyl-4-(2-dimethylaminoethyl)-[1,3]-dioxolane (DLin-K-C2-DMA), 2,2-dilinoleyl-4-dimethylaminomethyl-[1,3]-dioxolane (DLin-K-DMA), (6Z,9Z,28Z,31Z)-heptatriaconta-6,9,28 31-tetraen-19-yl 4-(dimethylamino) butanoate (DLin-M-C3-DMA), 3-((6Z,9Z,28Z,31Z)-heptatriaconta-6,9,28,3 1-tetraen-19-yloxy)-N,N-dimethylpropan-1-amine (MC3 Ether), 4-((6Z,9Z,28Z,31 Z)-heptatriaconta-6,9,28,31-tetraen-19-yloxy)-N,N-dimethylbutan-1-amine (MC4 Ether), or any combination thereof. Other cationic lipids include, but are not limited to, N,N-distearyl-N,N-dimethylammonium bromide (DDAB), 3P-(N-(N',N'-dimethylaminoethane)-carbamoyl) cholesterol (DC-Choi), N-(1-(2,3-dioleyloxy) propyl)-N-2-(sperminecarboxamido) ethyl)-N,N-dimethylammonium trifluoracetate (DOSPA), dioctadecylamidoglycyl carboxyspermine (DOGS), 1,2-dileoyl-sn-3-phosphoethanolamine (DOPE), 1,2-dioleoyl-3-dimethylammonium propane (DODAP), N-(1,2-dimyristyloxyprop-3-yl)-N,N-dimethyl-N-hydroxyethyl ammonium bromide (DMRIE), and 2,2-Dilinoleyl-4-dimethylaminoethyl-[1,3]-dioxolane (XTC). Additionally, commercial preparations of cationic lipids can be used, such as, e.g., LIPOFECTIN (including DOTMA and DOPE, available from GIBCO/BRL), and LIPOFECTAMINE (comprising DOSPA and DOPE, available from GIBCO/BRL).

Other suitable cationic lipids are disclosed in International Publication Nos. WO 09/086558, WO 09/127060, WO 10/048536, WO 10/054406, WO 10/088537, WO 10/129709, and WO 2011/153493; U.S. Patent Publication Nos. 2011/0256175, 2012/0128760, and 2012/0027803; U.S. Pat. No. 8,158,601; and Love et al., PNAS, 107(5), 1864-69, 2010, the contents of which are herein incorporated by reference.

Other suitable cationic lipids include those having alternative fatty acid groups and other dialkylamino groups, including those, in which the alkyl substituents are different (e.g., N-ethyl-N-methylamino-, and N-propyl-N-ethylamino-). These lipids are part of a subcategory of cationic lipids referred to as amino lipids. In some embodiments of the lipid formulations described herein, the cationic lipid is an amino lipid. In general, amino lipids having less saturated acyl chains are more easily sized, particularly when the complexes must be sized below about 0.3 microns, for purposes of filter sterilization. Amino lipids containing unsaturated fatty acids with carbon chain lengths in the range of $C_{14}$ to $C_{22}$ may be used. Other scaffolds can also be used to separate the amino group and the fatty acid or fatty alkyl portion of the amino lipid.

In some embodiments, the lipid formulation comprises the cationic lipid with Formula I according to the patent application PCT/EP2017/064066. In this context, the disclosure of PCT/EP2017/064066 is also incorporated herein by reference.

In some embodiments, amino or cationic lipids of the present disclosure are ionizable and have at least one protonatable or deprotonatable group, such that the lipid is positively charged at a pH at or below physiological pH (e.g., pH 7.4), and neutral at a second pH, preferably at or above physiological pH. Of course, it will be understood that the addition or removal of protons as a function of pH is an equilibrium process, and that the reference to a charged or a neutral lipid refers to the nature of the predominant species and does not require that all of the lipid be present in the charged or neutral form. Lipids that have more than one protonatable or deprotonatable group, or which are zwitterionic, are not excluded from use in the disclosure. In certain embodiments, the protonatable lipids have a pKa of the protonatable group in the range of about 4 to about 11. In some embodiments, the ionizable cationic lipid has a pKa of about 5 to about 7. In some embodiments, the pKa of an ionizable cationic lipid is about 6 to about 7.

In some embodiments, the lipid formulation comprises an ionizable cationic lipid of Formula I:

(I)

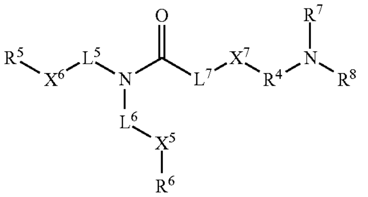

or a pharmaceutically acceptable salt or solvate thereof, wherein $R^5$ and $R^6$ are each independently selected from the group consisting of a linear or branched $C_1$-$C_{31}$ alkyl, $C_2$-$C_{31}$ alkenyl or $C_2$-$C_{31}$ alkynyl and cholesteryl; $L^5$ and $L^6$ are each independently selected from the group consisting of a linear $C_1$-$C_{20}$ alkyl and $C_2$-$C_{20}$ alkenyl; $X^5$ is —C(O)O—, whereby —C(O)O—$R^6$ is formed or —OC(O)— whereby —OC(O)—$R^6$ is formed; $X^6$ is —C(O)O— whereby —C(O)O—$R^5$ is formed or —OC(O)— whereby —OC(O)—$R^5$ is formed; $X^7$ is S or O; $L^7$ is absent or lower alkyl; $R^4$ is a linear or branched $C_1$-$C_6$ alkyl; and $R^7$ and $R^8$ are each independently selected from the group consisting of a hydrogen and a linear or branched $C_1$-$C_6$ alkyl.

In some embodiments, $X^7$ is S.

In some embodiments, $X^5$ is —C(O)O—, whereby —C(O)O—$R^6$ is formed and $X^6$ is —C(O)O— whereby —C(O)O—$R^5$ is formed.

In some embodiments, $R^7$ and $R^8$ are each independently selected from the group consisting of methyl, ethyl and isopropyl.

In some embodiments, $L^5$ and $L^6$ are each independently a $C_1$-$C_{10}$ alkyl. In some embodiments, $L^5$ is $C_1$-$C_3$ alkyl, and $L^6$ is $C_1$-$C_5$ alkyl. In some embodiments, $L^6$ is $C_1$-$C_2$ alkyl. In some embodiments, $L^5$ and $L^6$ are each a linear $C_7$ alkyl. In some embodiments, $L^5$ and $L^6$ are each a linear $C_9$ alkyl.

In some embodiments, $R^5$ and $R^6$ are each independently an alkenyl. In some embodiments, $R^6$ is alkenyl. In some embodiments, $R^6$ is $C_2$-$C_9$ alkenyl. In some embodiments, the alkenyl comprises a single double bond. In some embodiments, $R^5$ and $R^6$ are each alkyl. In some embodiments, $R^5$ is a branched alkyl. In some embodiments, $R^5$ and $R^6$ are each independently selected from the group consisting of a $C_9$ alkyl, $C_9$ alkenyl and $C_9$ alkynyl. In some embodiments, $R^5$ and $R^6$ are each independently selected from the group consisting of a $C_{11}$ alkyl, $C_{11}$ alkenyl and $C_{11}$ alkynyl. In some embodiments, $R^5$ and $R^6$ are each independently selected from the group consisting of a $C_7$ alkyl, $C_7$ alkenyl and $C_7$ alkynyl. In some embodiments, $R^5$ is $—CH((CH_2)_pCH_3)_2$ or $—CH((CH_2)_pCH_3)((CH_2)_{p-1}CH_3)$, wherein p is 4-8. In some embodiments, p is 5 and $L^5$ is a $C_1$. $C_3$ alkyl. In some embodiments, p is 6 and $L^5$ is a $C_3$ alkyl. In some embodiments, p is 7. In some embodiments, p is 8 and $L^5$ is a $C_1$-$C_3$ alkyl. In some embodiments, $R^5$ consists of $—CH((CH_2)_pCH_3)((CH_2)_{p-1}CH_3)$, wherein p is 7 or 8.

In some embodiments, $R^4$ is ethylene or propylene. In some embodiments, $R^4$ is n-propylene or isobutylene.

In some embodiments, $L^7$ is absent, $R^4$ is ethylene, $X^7$ is S and $R^7$ and $R^8$ are each methyl. In some embodiments, $L^7$ is absent, $R^4$ is n-propylene, $X^7$ is S and $R^7$ and $R^8$ are each methyl. In some embodiments, $L^7$ is absent, $R^4$ is ethylene, $X^7$ is S and $R^7$ and $R^8$ are each ethyl.

In some embodiments, $X^7$ is S, $X^5$ is —C(O)O—, whereby —C(O)O—$R^6$ is formed, $X^6$ is —C(O)O— whereby —C(O)O—$R^5$ is formed, $L^5$ and $L^6$ are each independently a linear $C_3$-$C_7$ alkyl, $L^7$ is absent, $R^5$ is $—CH((CH_2)_pCH_3)_2$, and $R^6$ is $C_7$-$C_{12}$ alkenyl. In some further embodiments, p is 6 and $R^6$ is $C_9$ alkenyl.

In some embodiments, the lipid formulation comprises an ionizable cationic lipid selected from the group consisting of

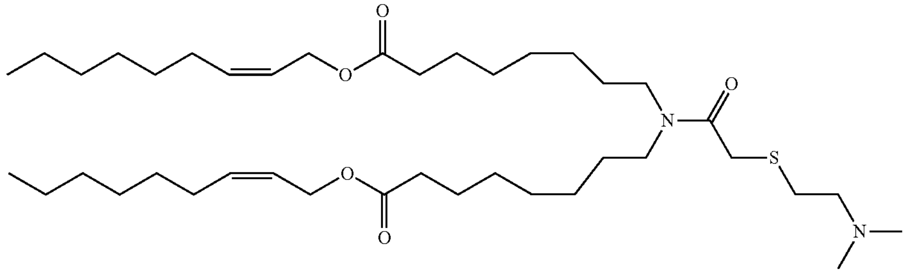

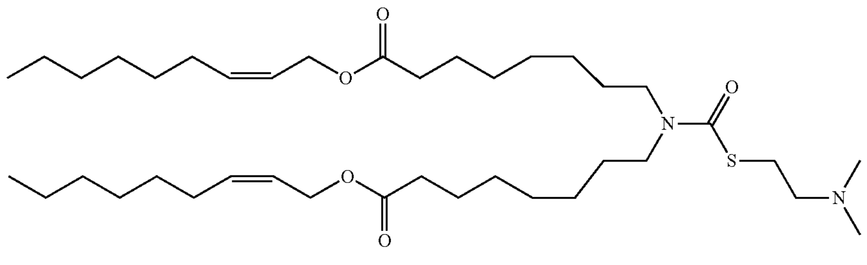

-continued
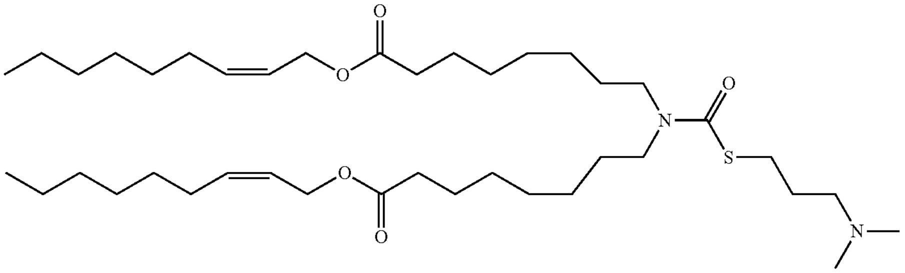
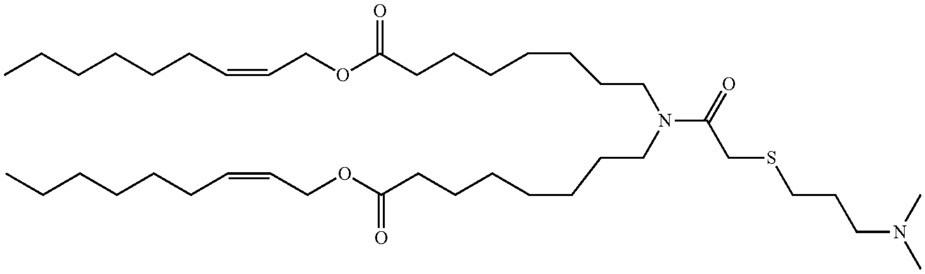
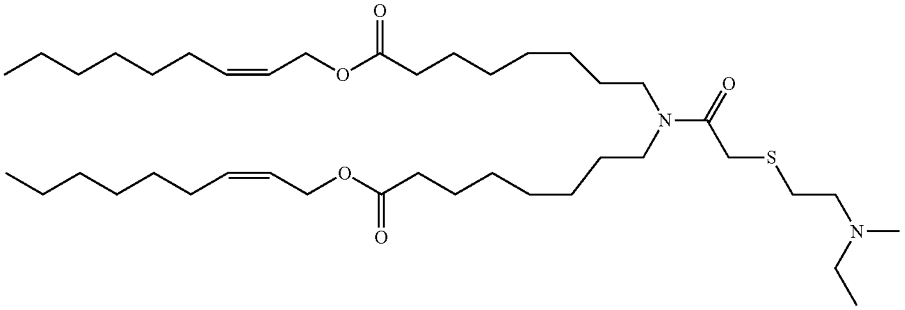
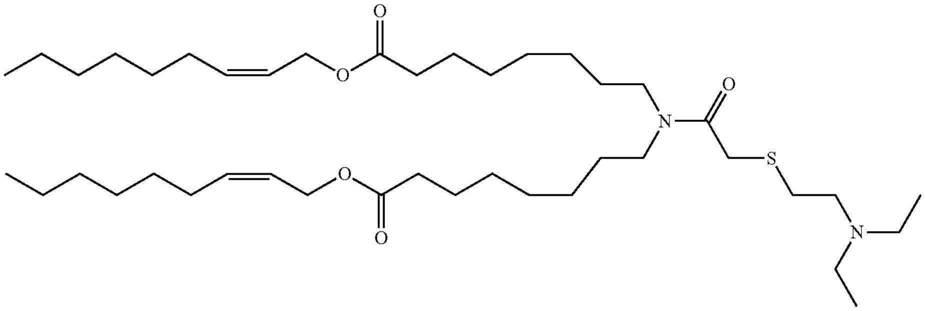
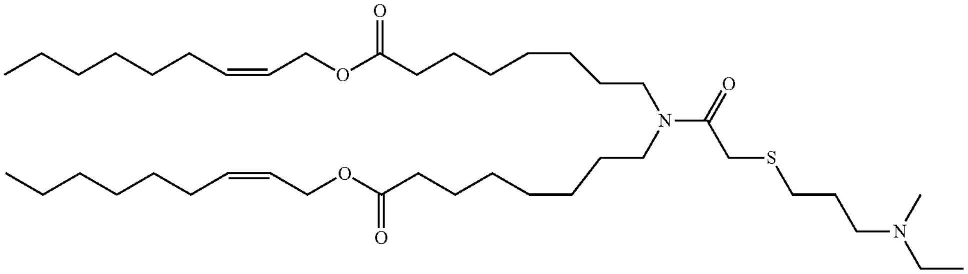
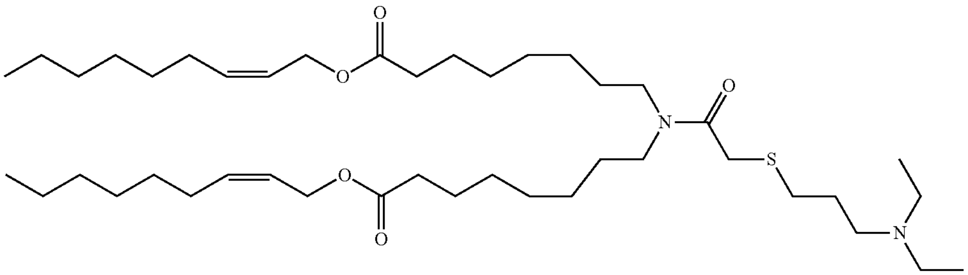

-continued
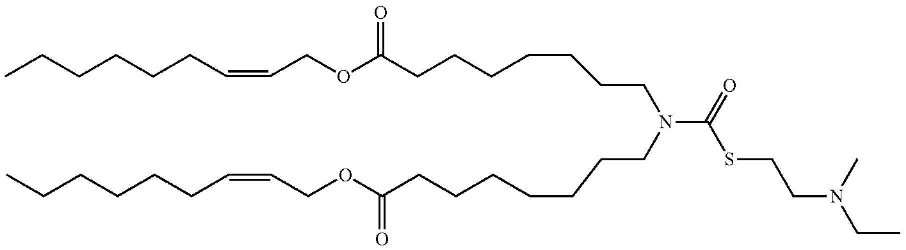
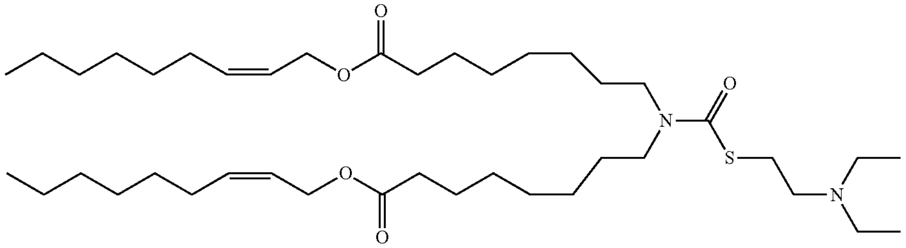
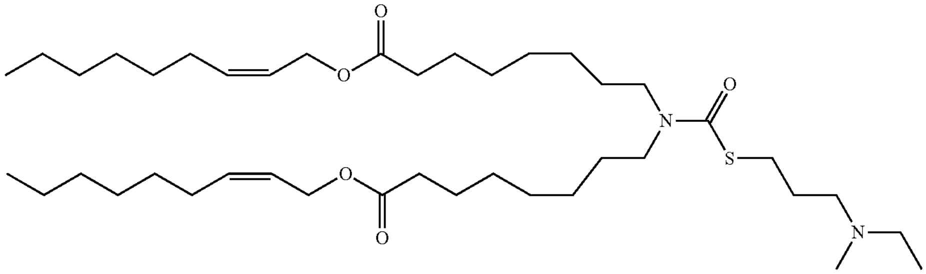
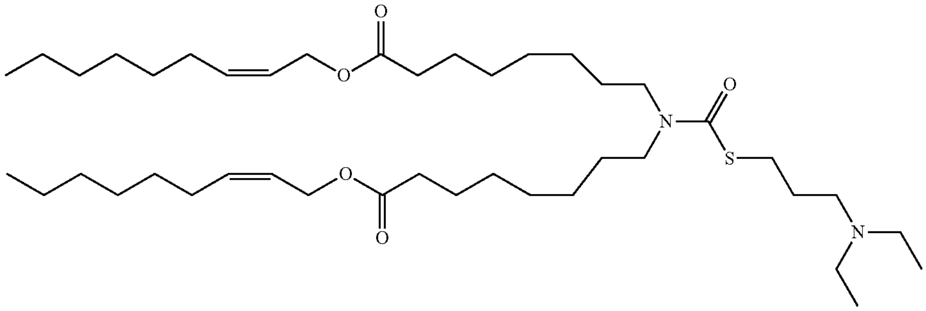
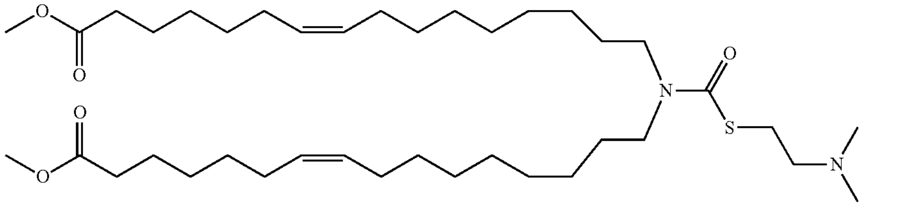
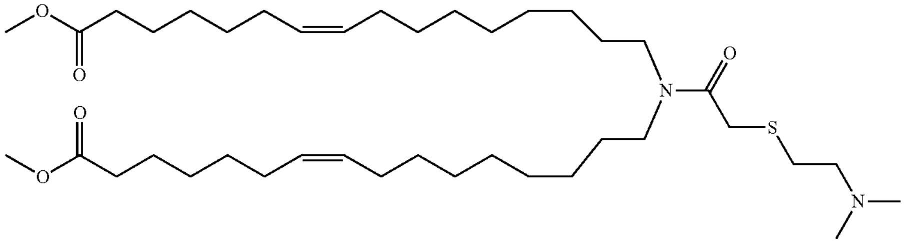

-continued
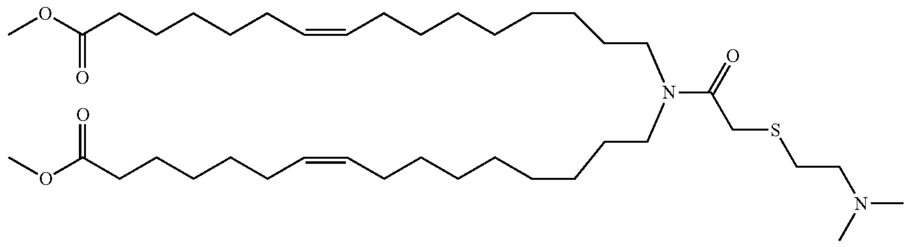
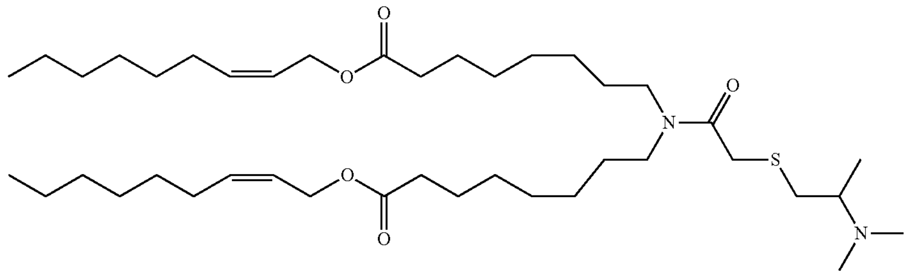
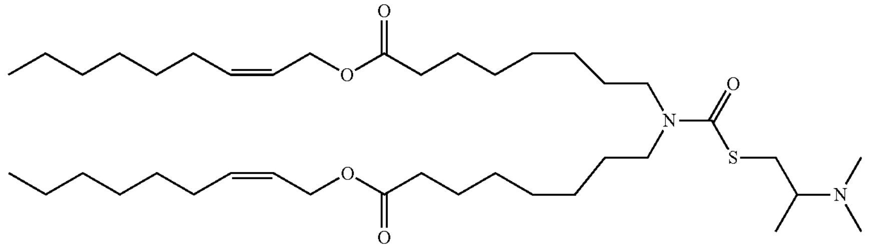
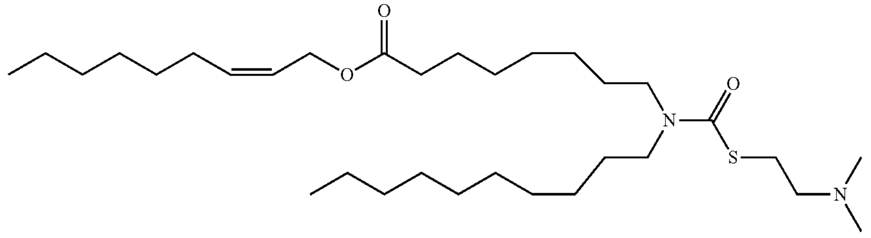
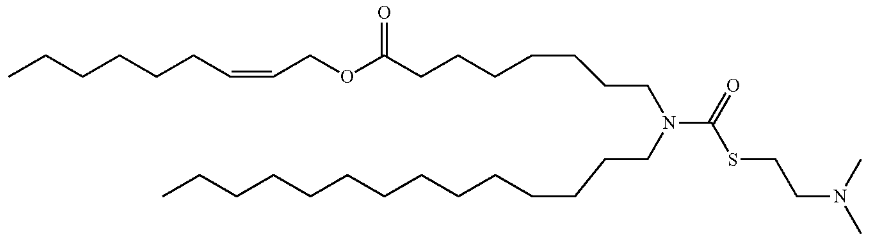
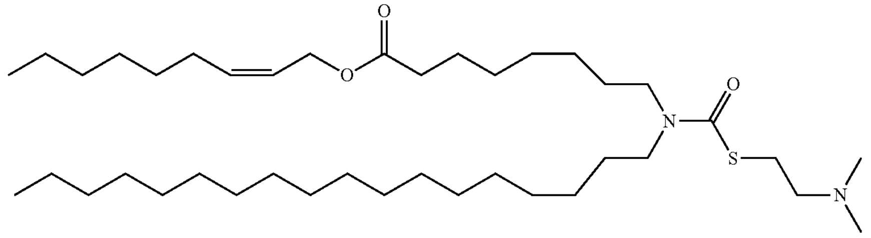

-continued
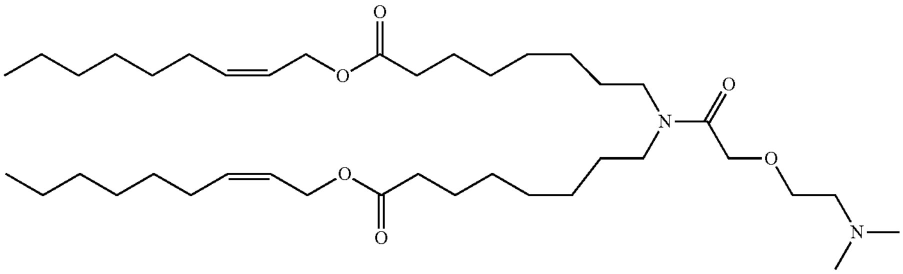
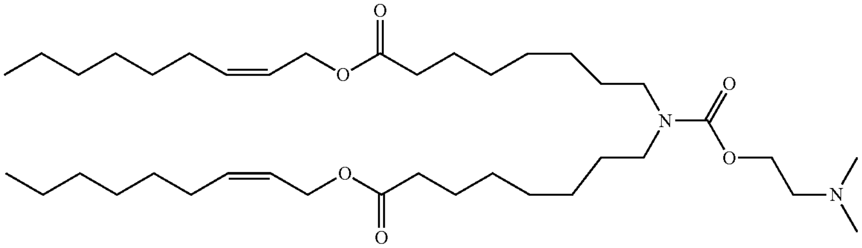
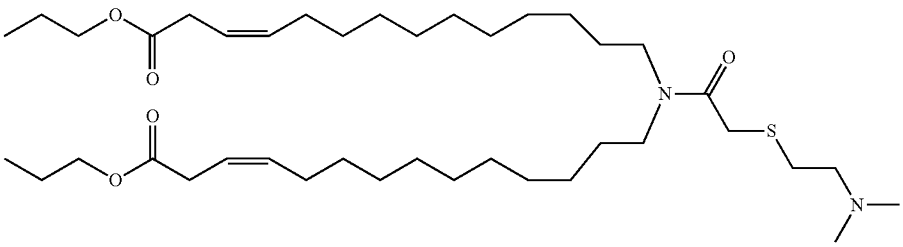
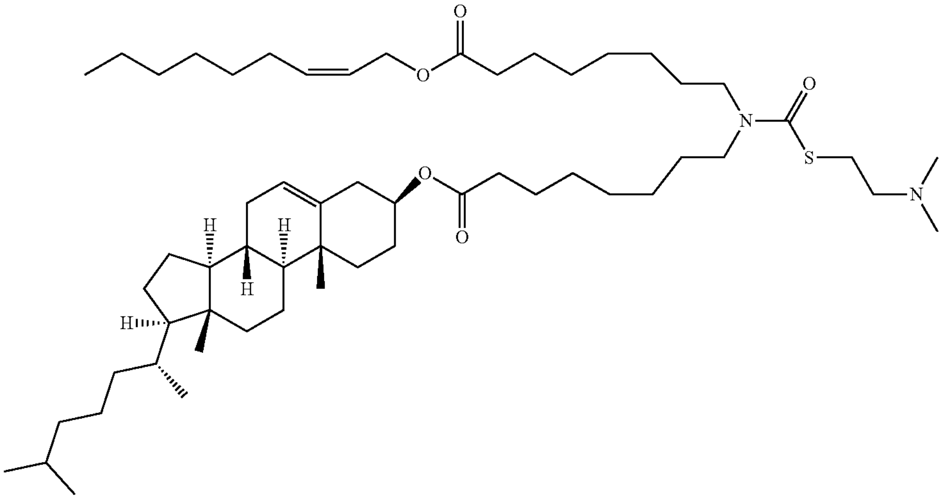

-continued
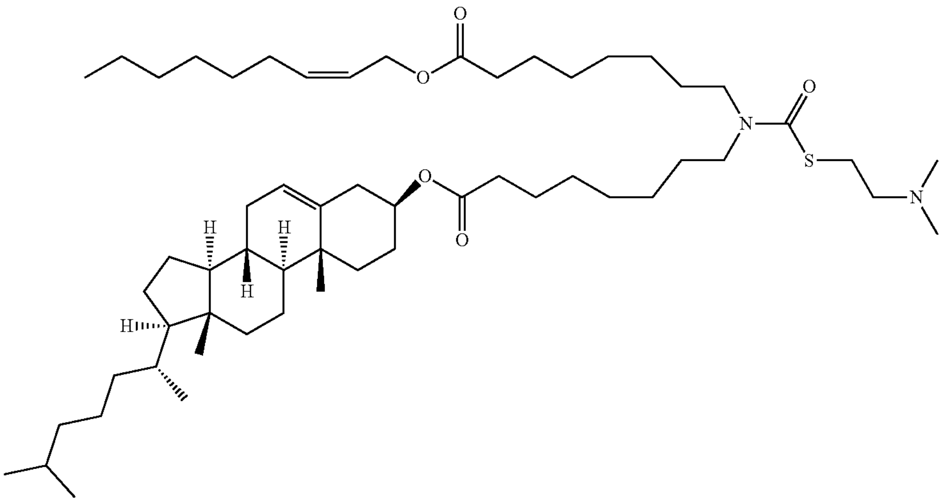
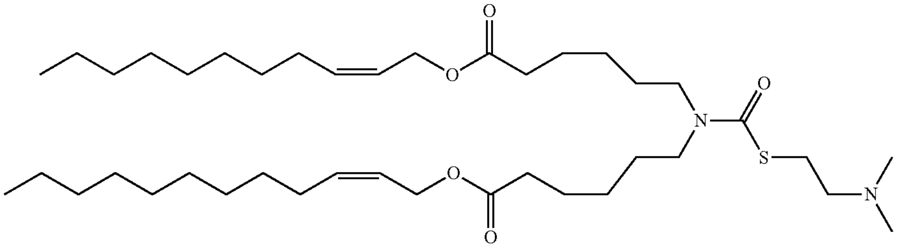
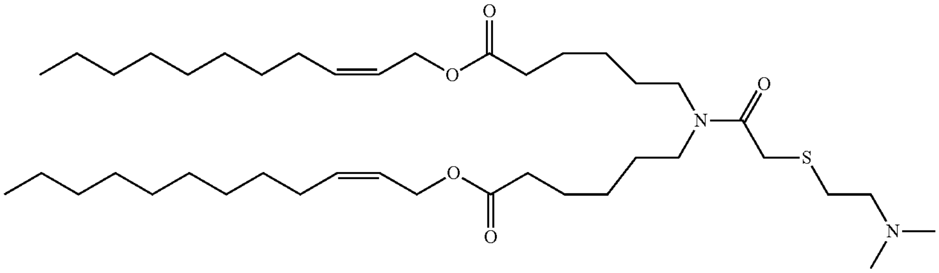
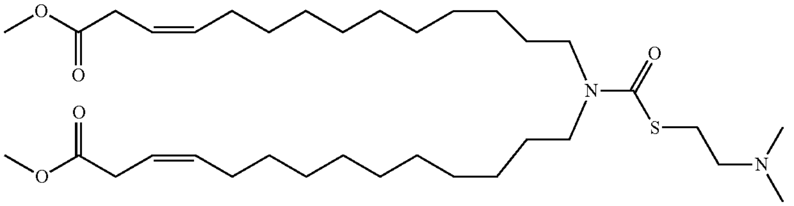
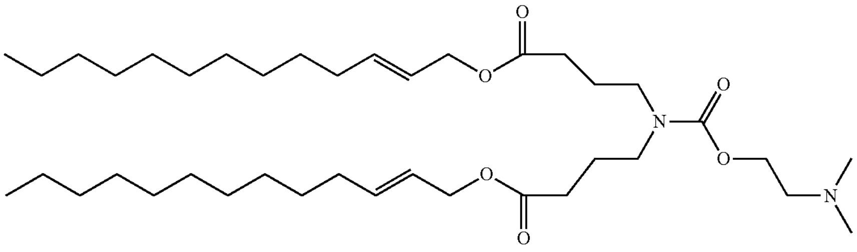

-continued
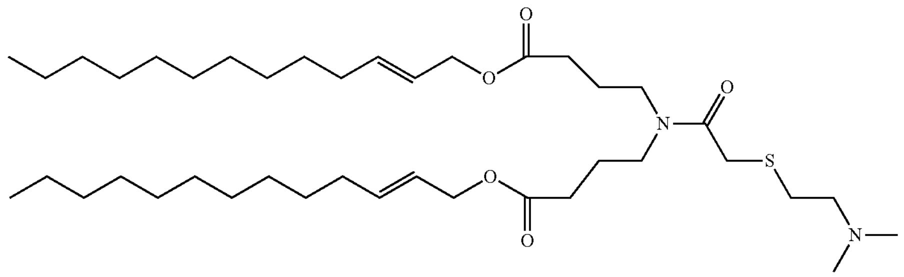
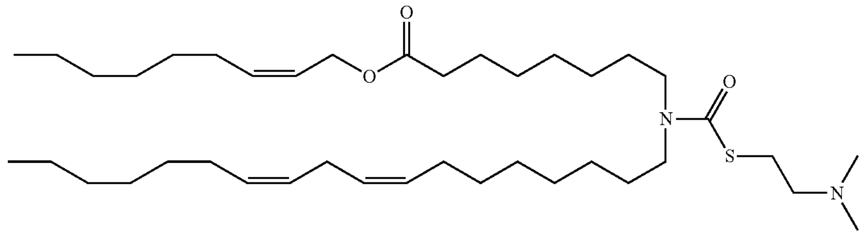
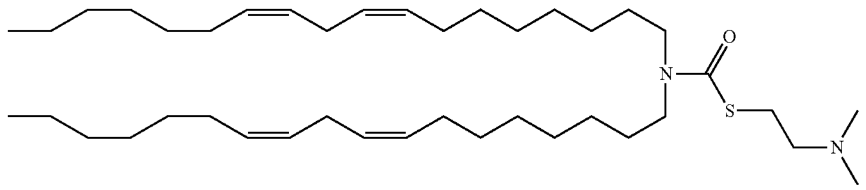
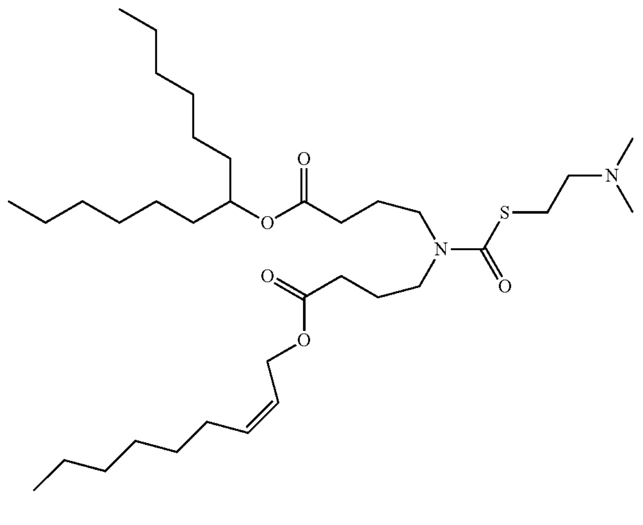

-continued
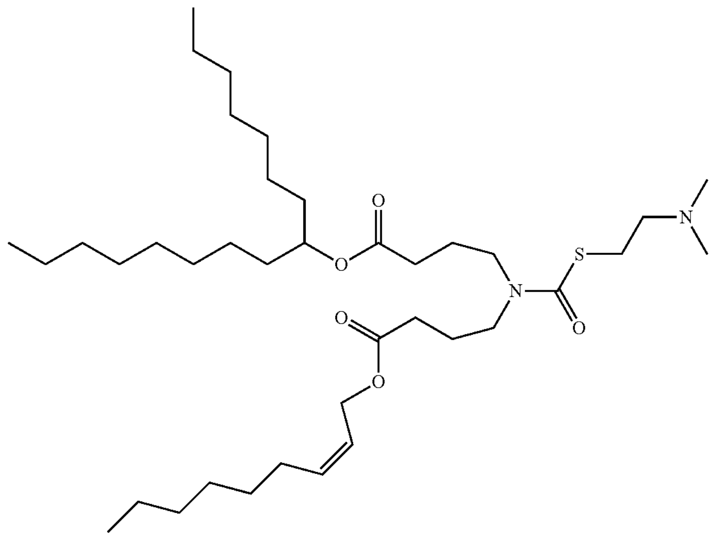
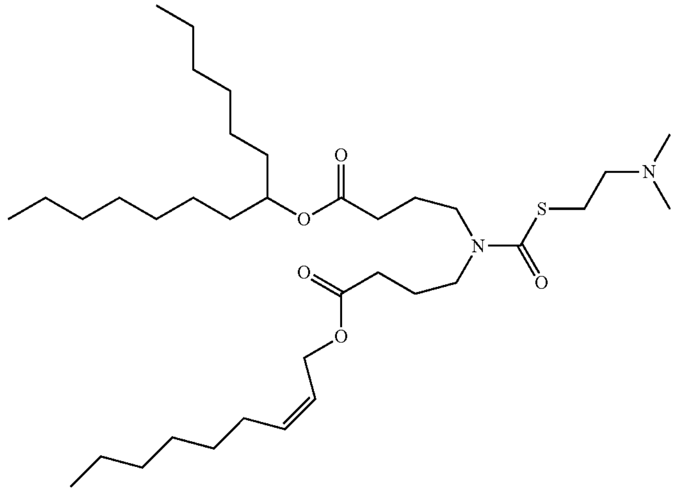
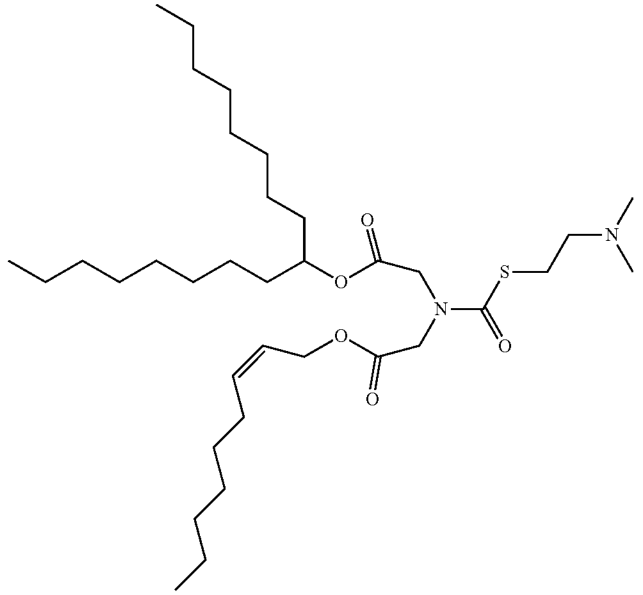
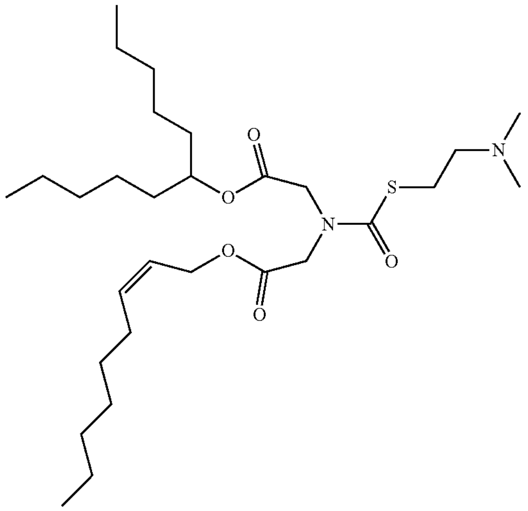

-continued
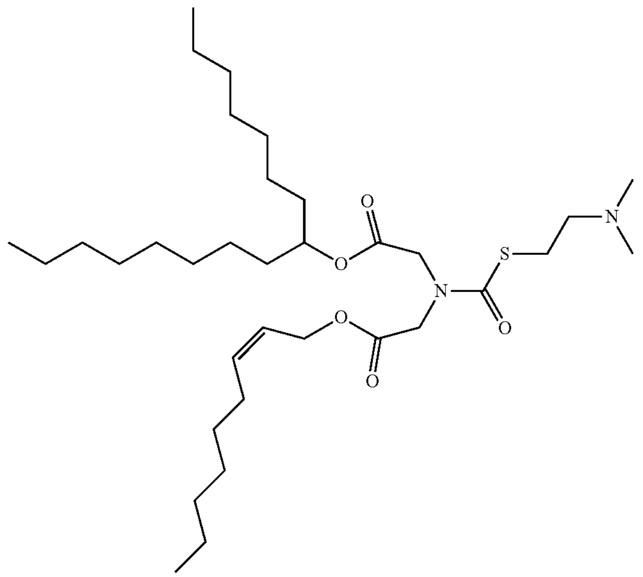
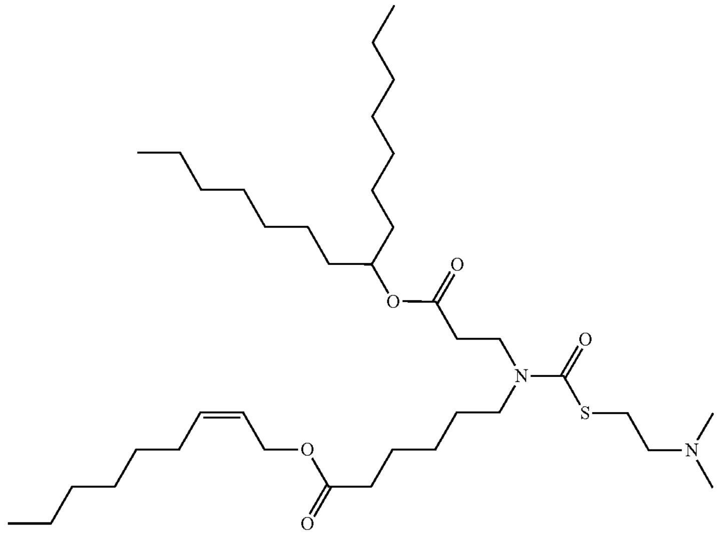
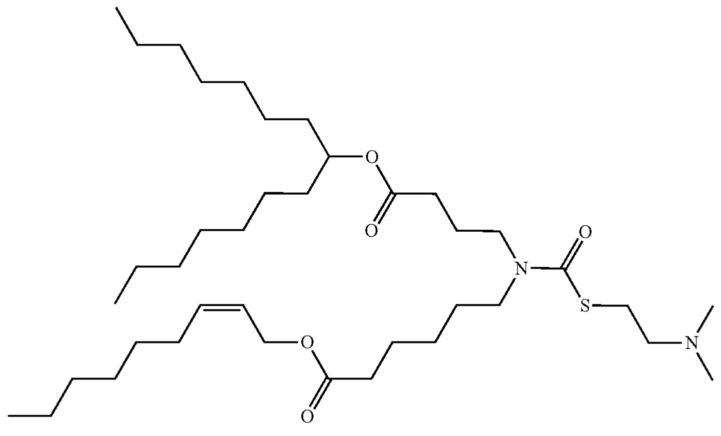

-continued
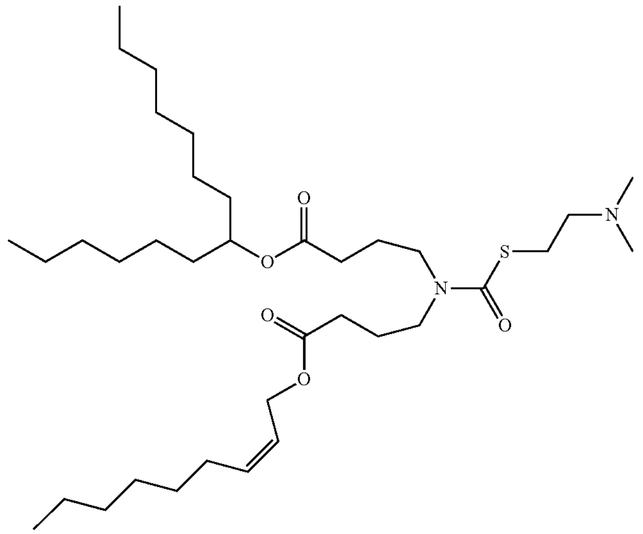
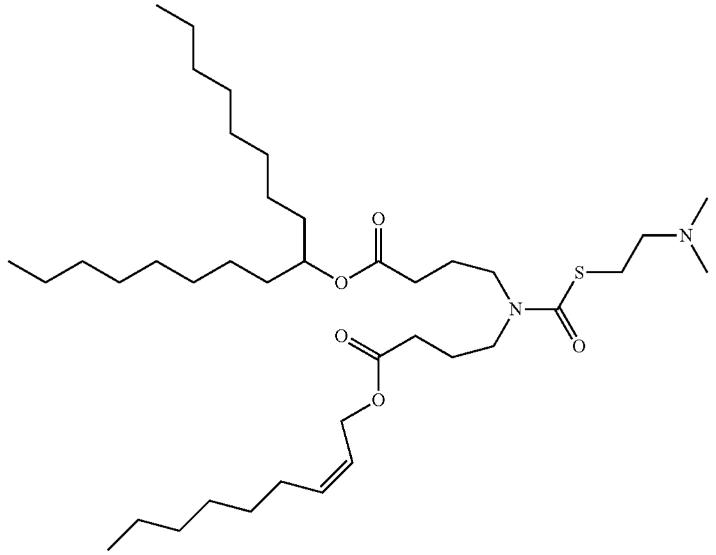
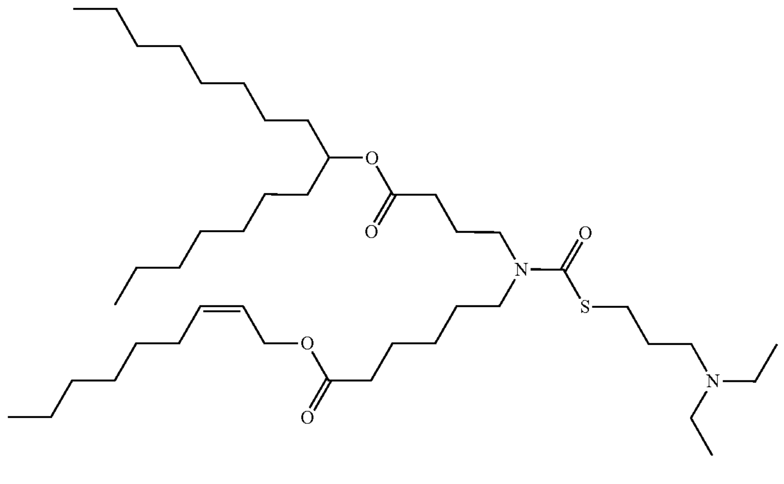

-continued
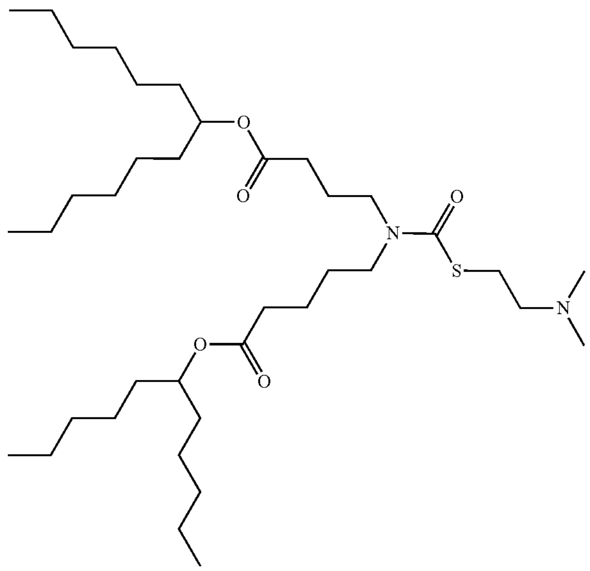
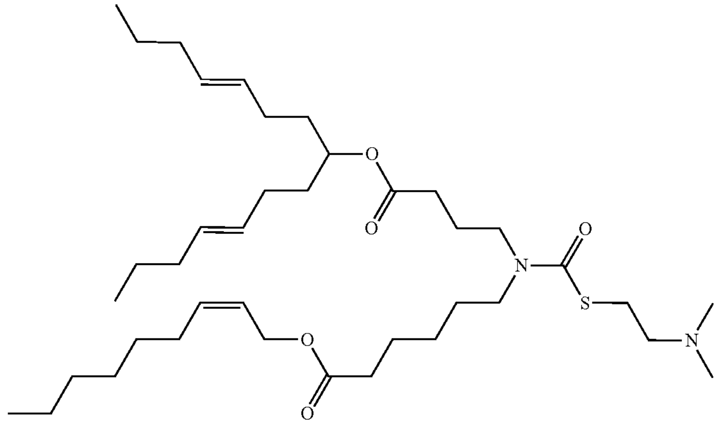
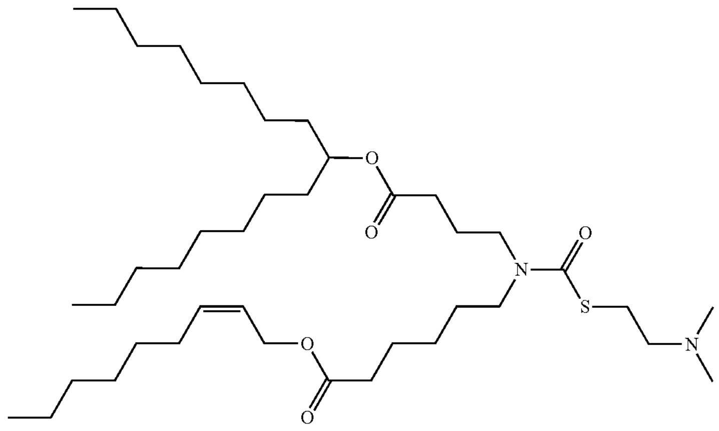

-continued
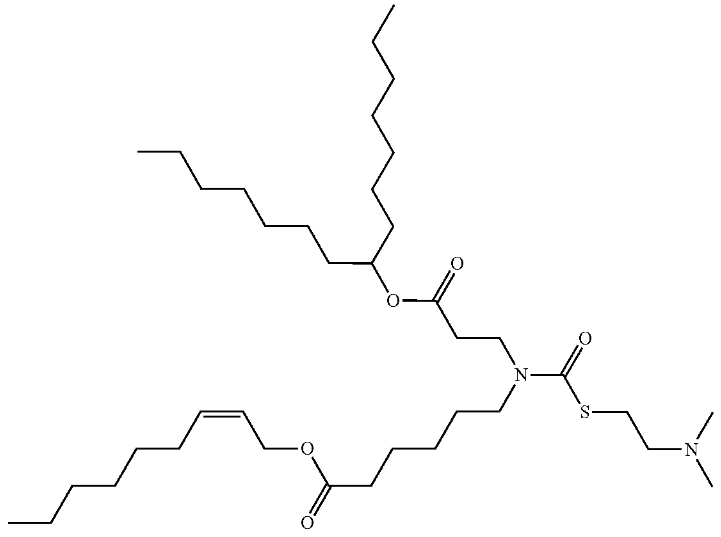
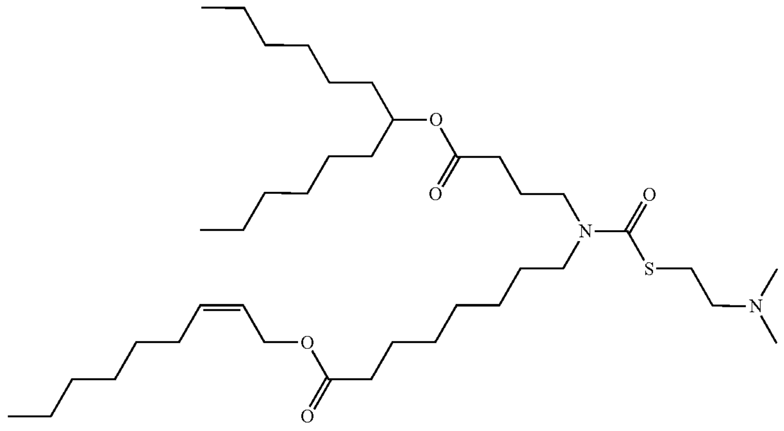
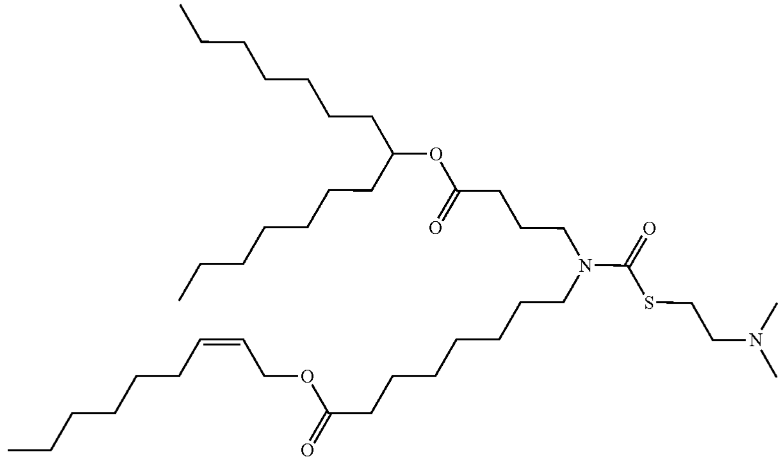

-continued
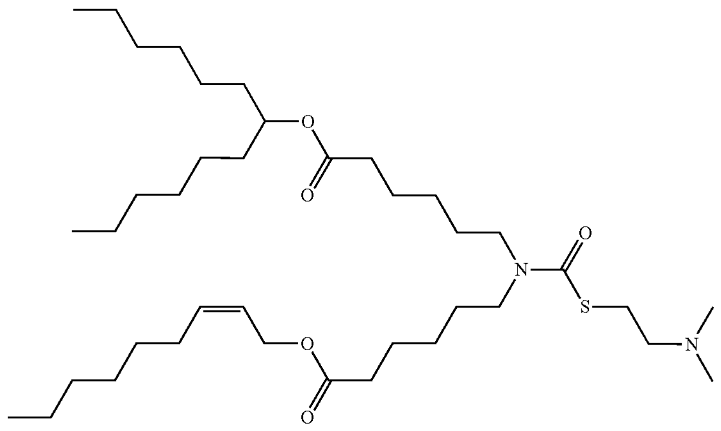
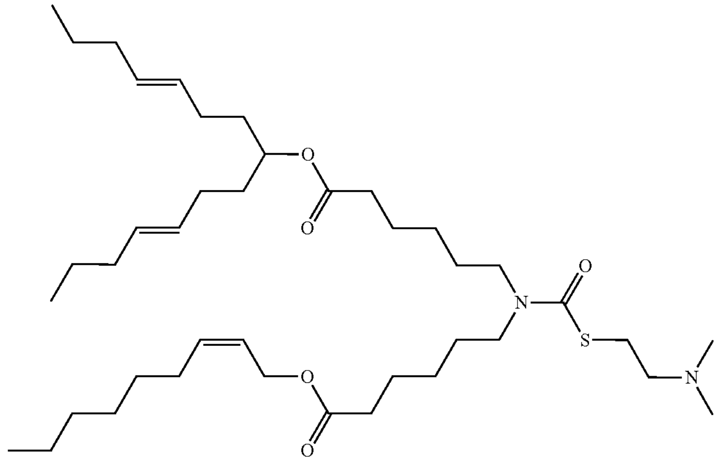
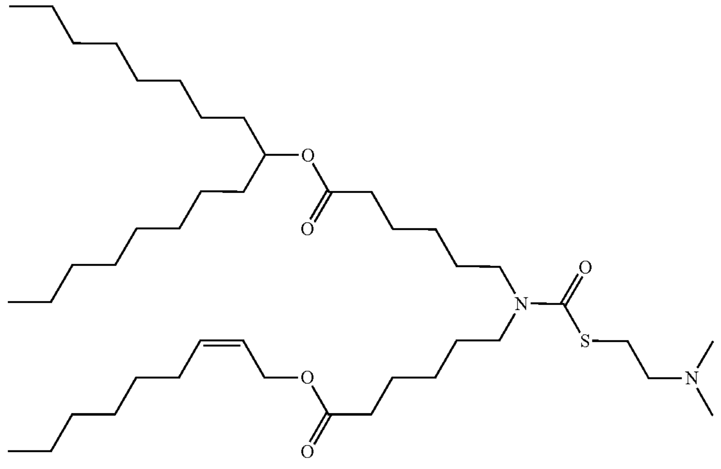

-continued
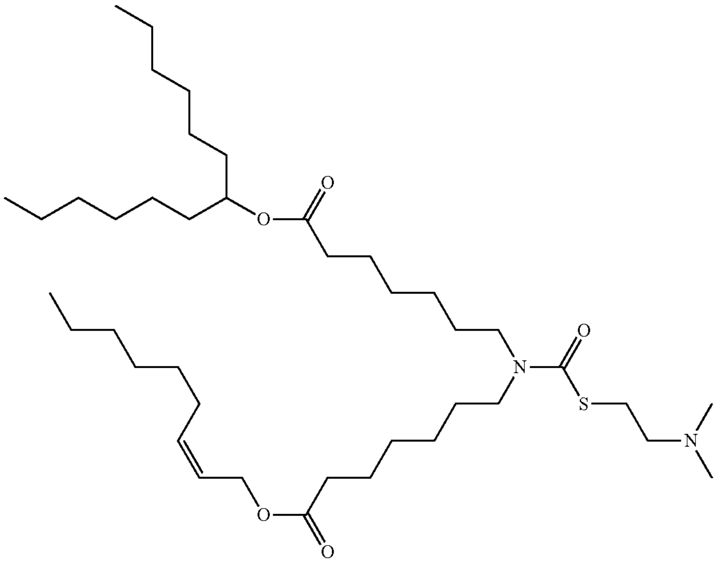
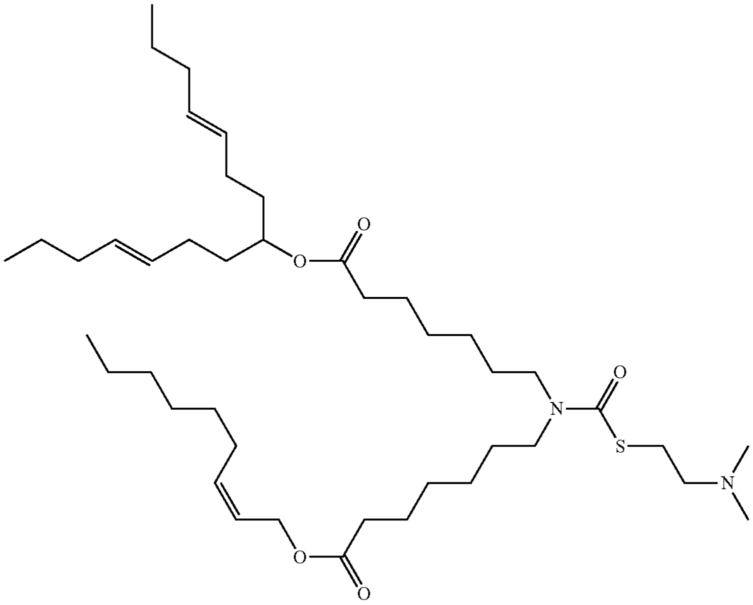
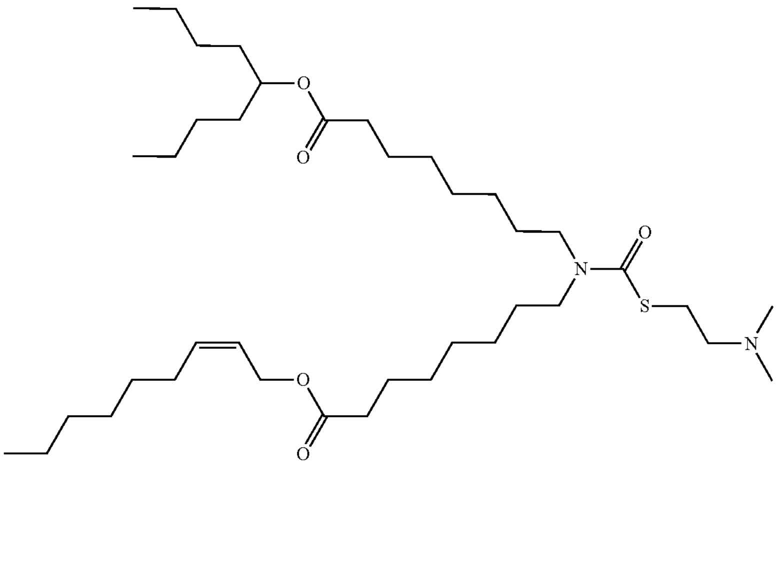

-continued
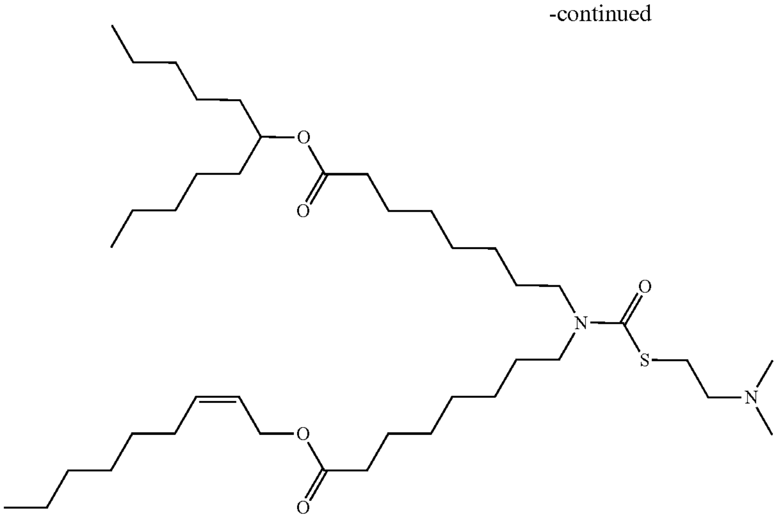
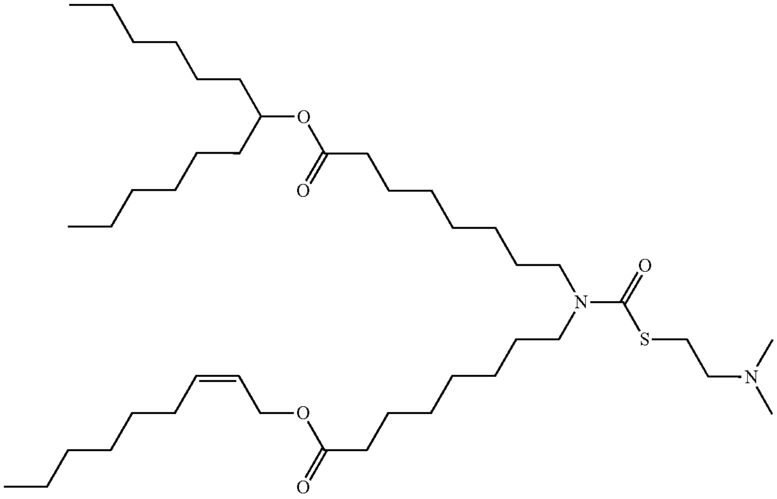
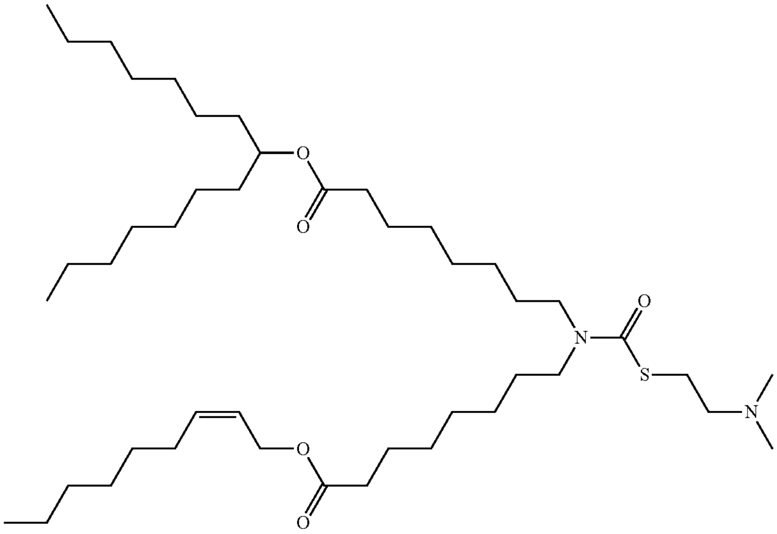

-continued
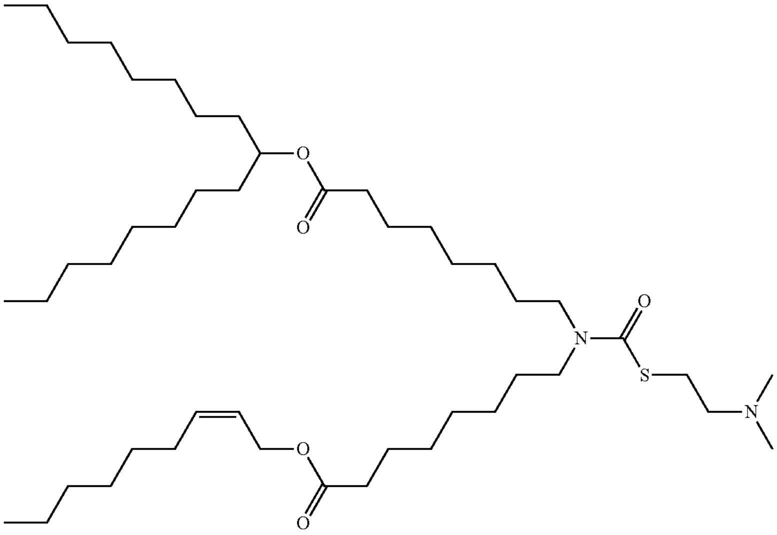
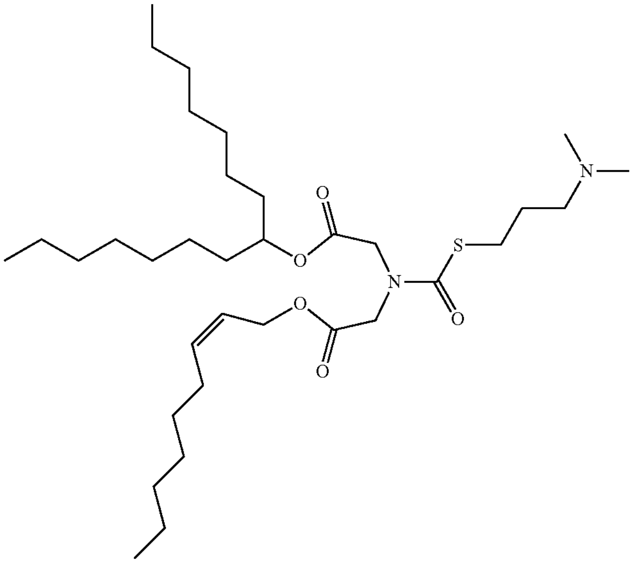
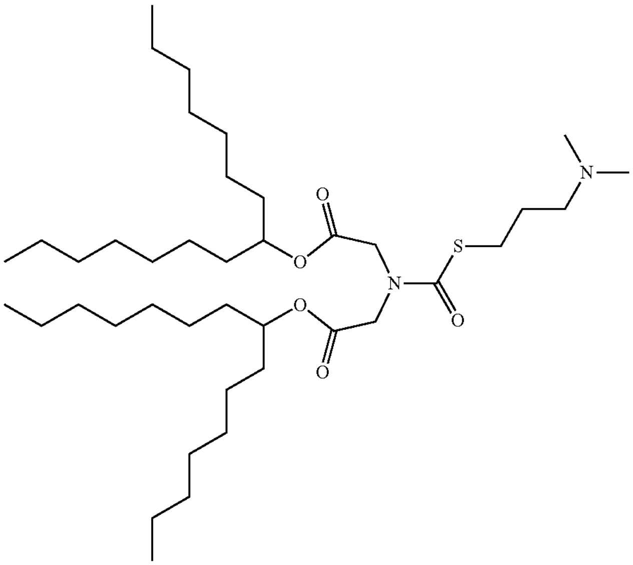

-continued
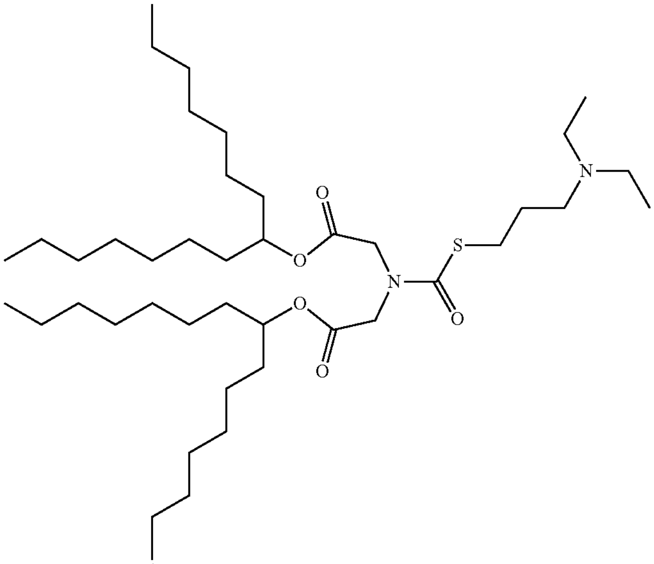
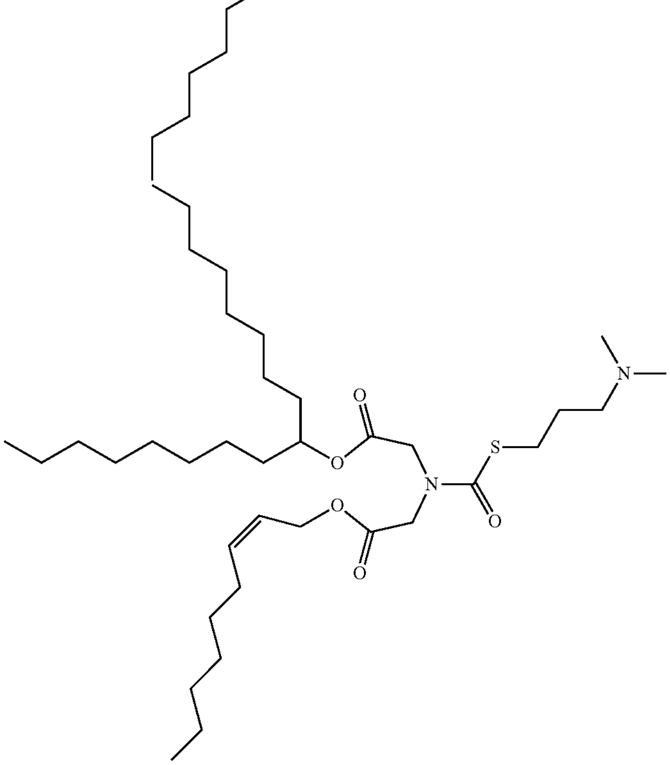
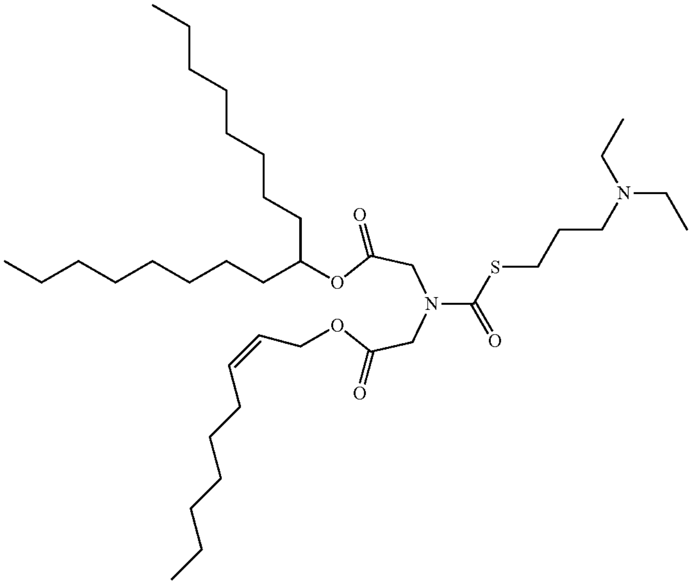

-continued
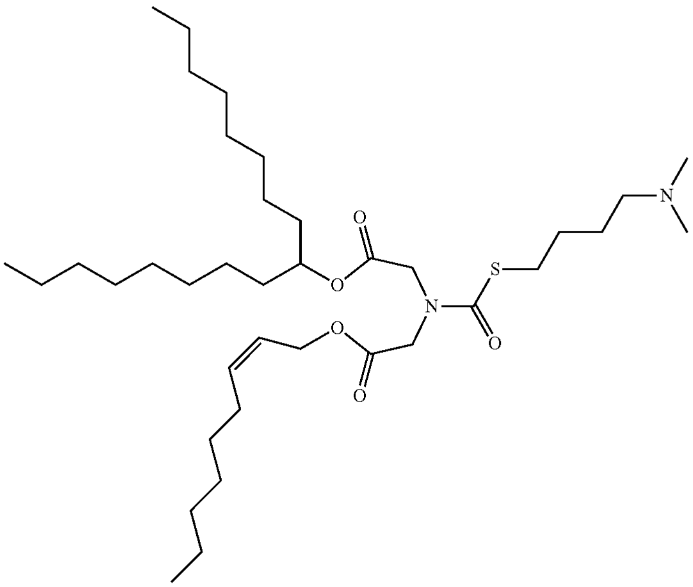
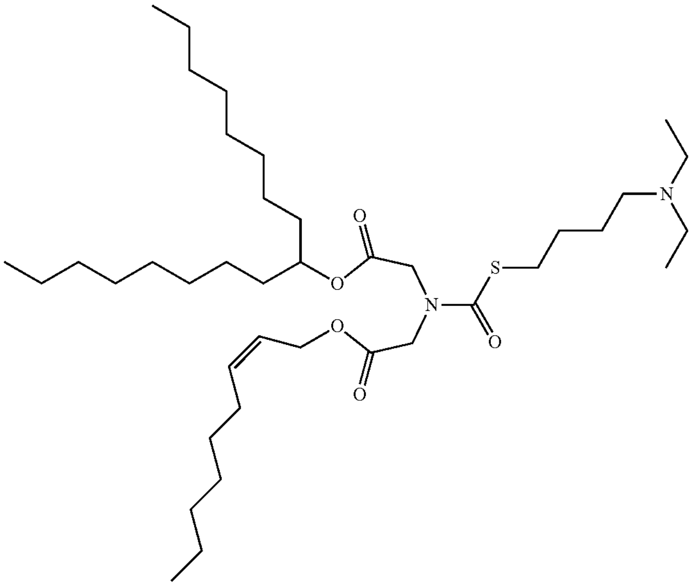
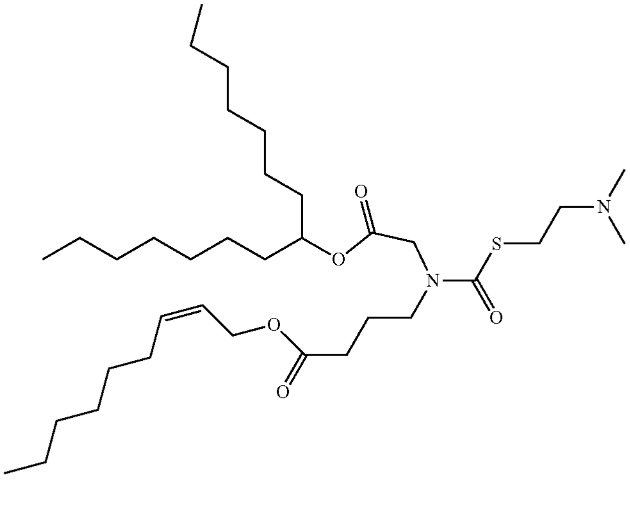

-continued
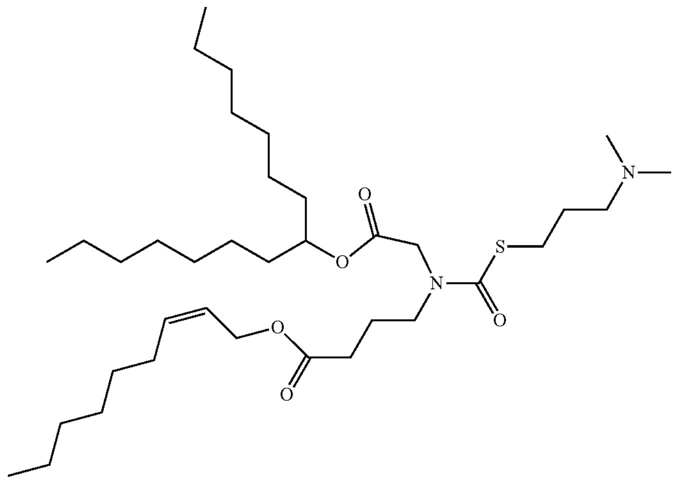
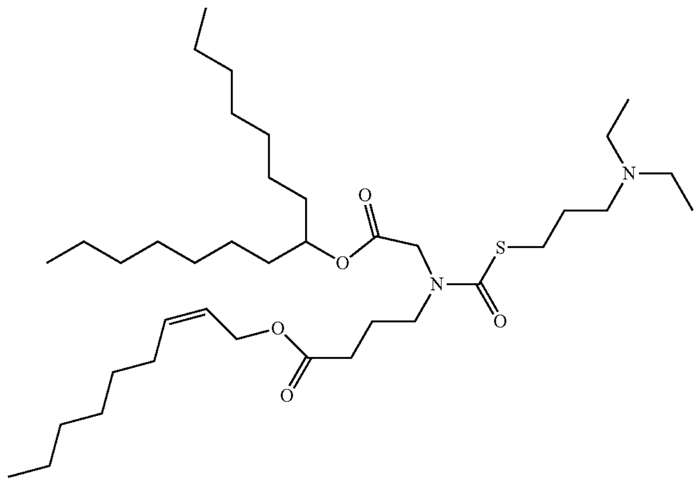
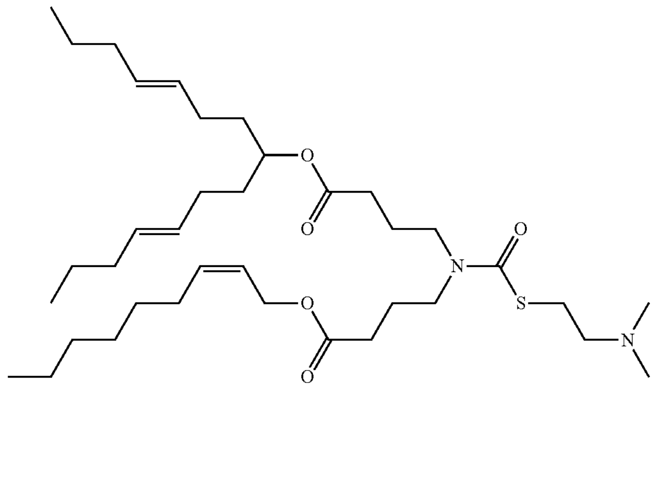

-continued
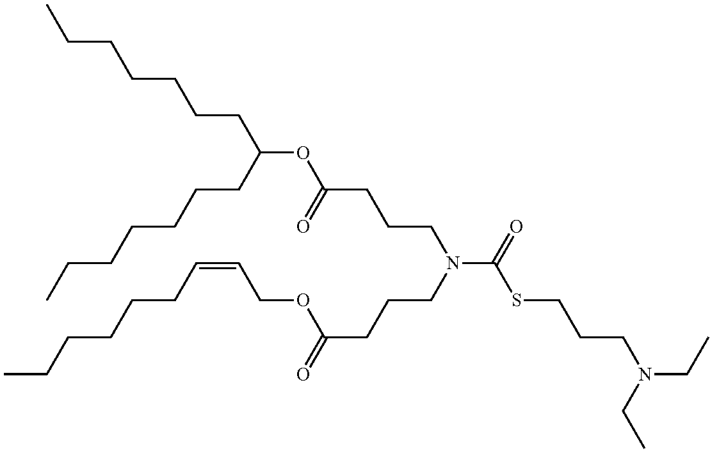
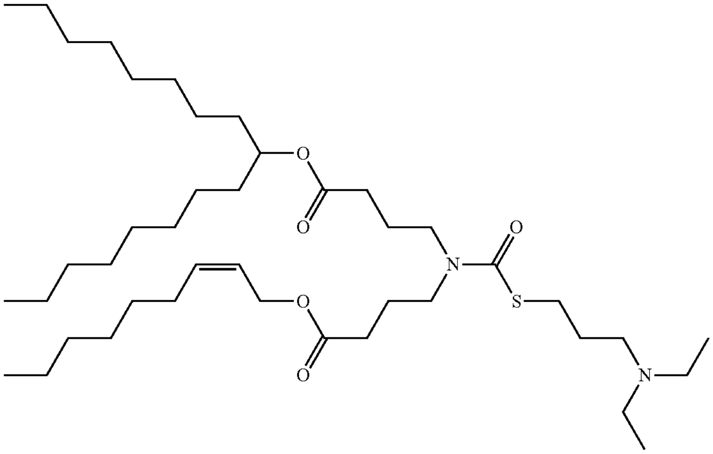
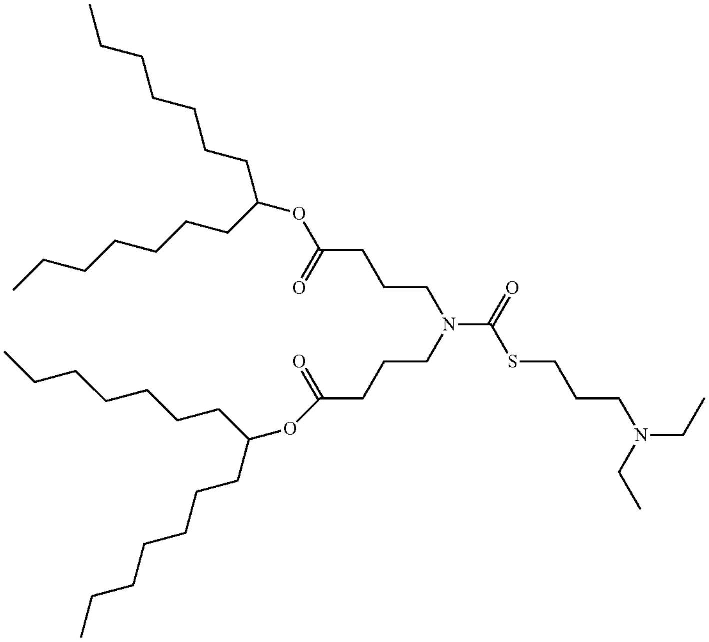

-continued
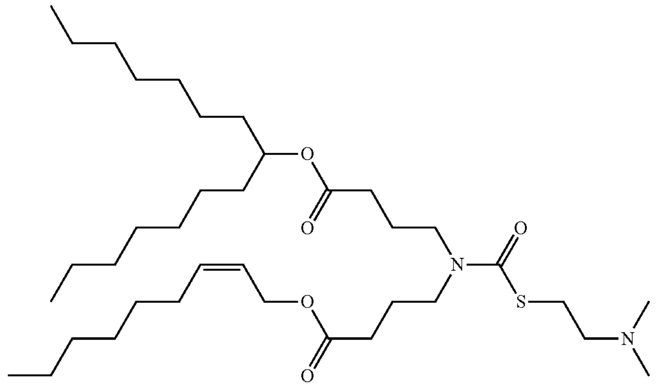
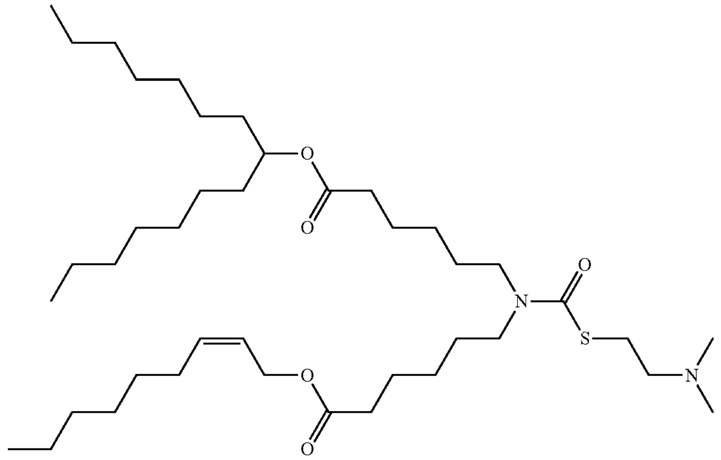
and
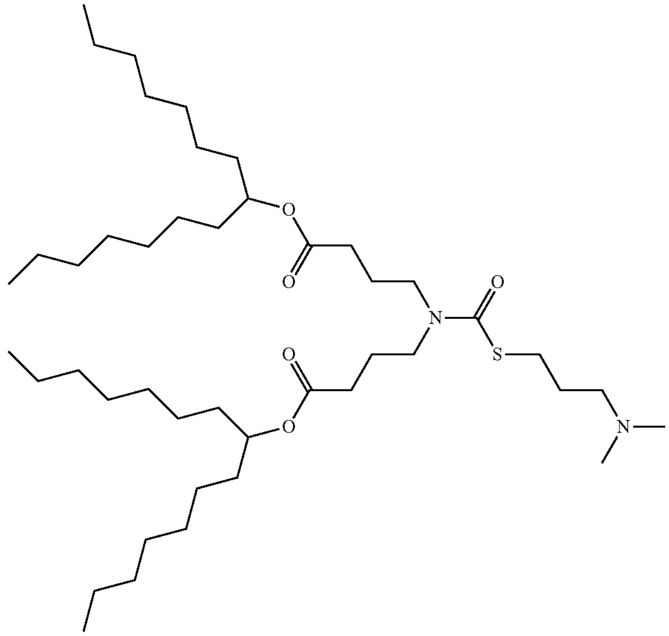
.

In some embodiments, the lipid formulation can comprise an ionizable cationic lipid selected from the group consisting of LIPID #1 to LIPID #5:
| LIPID # | STRUCTURE |
| --- | --- |
| 1 | 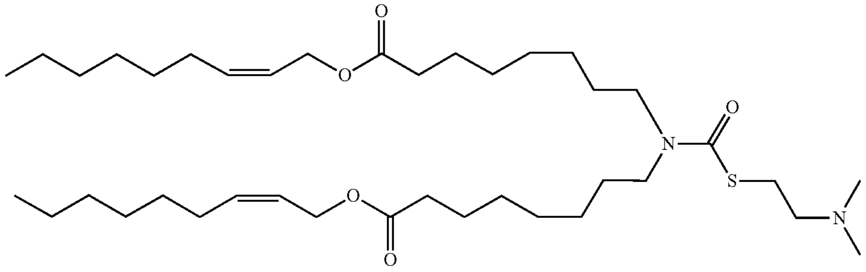 [SMILES: CCCCCC/C=C\COC(=O)CCCCCCCN(CCCCCCCC(=O)OC/C=C\CCCCCC)C(=O)SCCN(C)C] |
| 2 | 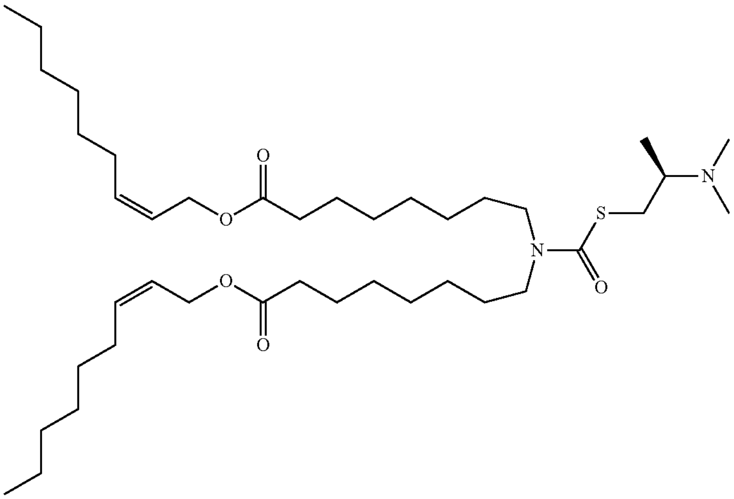 [SMILES: CCCCCC/C=C\COC(=O)CCCCCCCN(CCCCCCCC(=O)OC/C=C\CCCCCC)C(=O)SC[C@@H](C)N(C)C] |
| 3 | 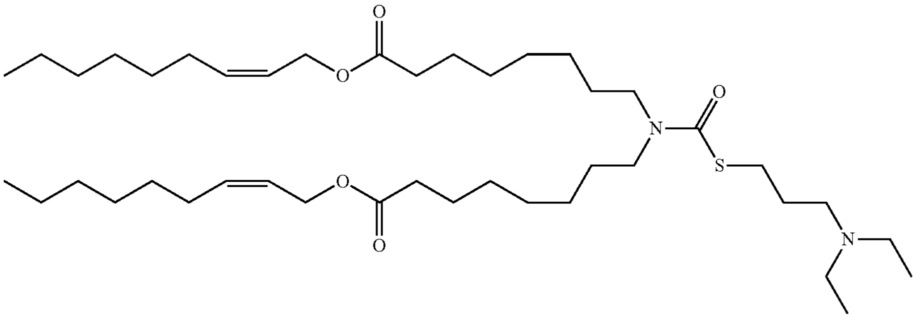 [SMILES: CCCCCC/C=C\COC(=O)CCCCCCCN(CCCCCCCC(=O)OC/C=C\CCCCCC)C(=O)SCCCN(CC)CC] |

-continued
| LIPID # | STRUCTURE |
| --- | --- |
| 4 | 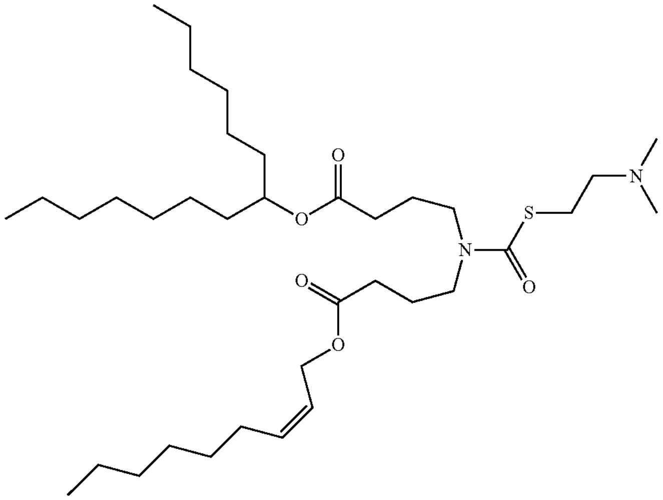 [SMILES: CCCCCC/C=C\COC(=O)CCCN(CCCC(=O)OC(CCCCCC)CCCCCCC)C(=O)SCCN(C)C] |
| 5 | 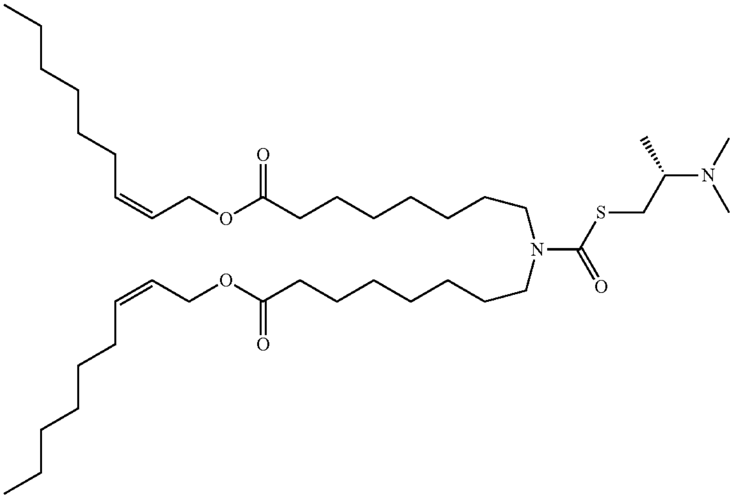 [SMILES: CCCCCC/C=C\COC(=O)CCCCCCCN(CCCCCCCC(=O)OC/C=C\CCCCCC)C(=O)SC[C@H](C)N(C)C] |
In some preferred embodiments, the lipid formulation comprises an ionizable cationic lipid having the structure
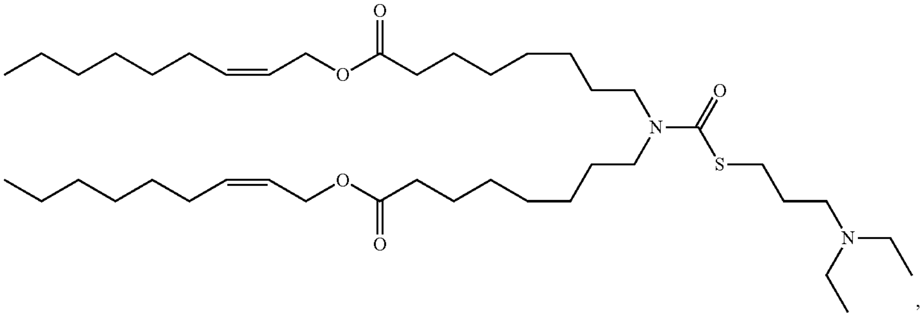 [SMILES: CCCCCC/C=C\COC(=O)CCCCCCCN(CCCCCCCC(=O)OC/C=C\CCCCCC)C(=O)SCCCN(CC)CC]
,
or a pharmaceutically acceptable salt thereof.

In some embodiments, any one or more lipids recited herein may be expressly excluded.

Helper Lipids and Sterols

The mRNA-lipid formulations of the present disclosure can comprise a helper lipid, which can be referred to as a neutral lipid, a neutral helper lipid, non-cationic lipid, non-cationic helper lipid, anionic lipid, anionic helper lipid, or a zwitterionic lipid. It has been found that lipid formulations, particularly cationic liposomes and lipid nanoparticles have increased cellular uptake if helper lipids are present in the formulation. (Curr. Drug Metab. 2014; 15(9):882-92). For example, some studies have indicated that neutral and zwitterionic lipids such as 1,2-dioleoyl-sn-glycero-3-phosphatidylcholine (DOPC), Di-Oleoyl-Phosphatidyl-Ethanoalamine (DOPE) and 1,2-DiStearoyl-sn-glycero-3-PhosphoCholine (DSPC), being more fusogenic (i.e., facilitating fusion) than cationic lipids, can affect the polymorphic features of lipid-nucleic acid complexes, promoting the transition from a lamellar to a hexagonal phase, and thus inducing fusion and a disruption of the cellular membrane. (Nanomedicine (Lond). 2014 January; 9(1):105-20). In addition, the use of helper lipids can help to reduce any potential detrimental effects from using many prevalent cationic lipids such as toxicity and immunogenicity.

Non-limiting examples of non-cationic lipids suitable for lipid formulations of the present disclosure include phospholipids such as lecithin, phosphatidylethanolamine, lysolecithin, lysophosphatidylethanolamine, phosphatidylserine, phosphatidylinositol, sphingomyelin, egg sphingomyelin (ESM), cephalin, cardiolipin, phosphatidic acid, cerebrosides, dicetylphosphate, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoylphosphatidylethanolamine (DOPE), palmitoyloleoyl-phosphatidylcholine (POPC), palmitoyloleoyl-phosphatidylethanolamine (POPE), palmitoylоleyol-phosphatidylgly cerol (POPG), dioleoylphosphatidylethanolamine 4-(N-maleimidomethyl)-cyclohexane-1-carboxylate (DOPE-mal), dipalmitoyl-phosphatidylethanolamine (DPPE), dimyristoyl-phosphatidylethanolamine (DMPE), distearoyl-phosphatidylethanolamine (DSPE), monomethyl-phosphatidylethanolamine, dimethyl-phosphatidylethanolamine, dielaidoyl-phosphatidylethanolamine (DEPE), stearoyloleoyl-phosphatidylethanolamine (SOPE), lysophosphatidylcholine, dilinoleoylphosphatidylcholine, and mixtures thereof. Other diacylphosphatidylcholine and diacylphosphatidylethanolamine phospholipids can also be used. The acyl groups in these lipids are preferably acyl groups derived from fatty acids having $C_{10}$-$C_{24}$ carbon chains, e.g., lauroyl, myristoyl, palmitoyl, stearoyl, or oleoyl.

Additional examples of non-cationic lipids include sterols such as cholesterol and derivatives thereof. One study concluded that as a helper lipid, cholesterol increases the spacing of the charges of the lipid layer interfacing with the nucleic acid making the charge distribution match that of the nucleic acid more closely. (J. R. Soc. Interface. 2012 Mar. 7; 9(68): 548-561). Non-limiting examples of cholesterol derivatives include polar analogues such as 5α-cholestanol, 5α-coprostanol, cholesteryl-(2'-hydroxy)-ethyl ether, cholesteryl-(4'-hydroxy)-butyl ether, and 6-ketocholestanol; non-polar analogues such as 5α-cholestane, cholestenone, 5α-cholestanone, 5α-cholestanone, and cholesteryl decanoate; and mixtures thereof. In preferred embodiments, the cholesterol derivative is a polar analogue such as cholesteryl-(4'-hydroxy)-butyl ether.

In some embodiments, the helper lipid present in the lipid formulation comprises or consists of a mixture of one or more phospholipids and cholesterol or a derivative thereof. In other embodiments, the helper lipid present in the lipid formulation comprises or consists of one or more phospholipids, e.g., a cholesterol-free lipid formulation. In yet other embodiments, the helper lipid present in the lipid formulation comprises or consists of cholesterol or a derivative thereof, e.g., a phospholipid-free lipid formulation.

Other examples of helper lipids include nonphosphorous containing lipids such as, e.g., stearylamine, dodecylamine, hexadecylamine, acetyl palmitate, glycerol ricinoleate, hexadecyl stearate, isopropyl myristate, amphoteric acrylic polymers, triethanolamine-lauryl sulfate, alkyl-aryl sulfate polyethyloxylated fatty acid amides, dioctadecyldimethyl ammonium bromide, ceramide, and sphingomyelin.

In some embodiments, the helper lipid comprises from about 20 mol % to about 50 mol %, from about 22 mol % to about 48 mol %, from about 24 mol % to about 46 mol %, about 25 mol % to about 44 mol %, from about 26 mol % to about 42 mol %, from about 27 mol % to about 41 mol %, from about 28 mol % to about 40 mol %, or about 29 mol %, about 30 mol %, about 31 mol %, about 32 mol %, about 33 mol %, about 34 mol %, about 35 mol %, about 36 mol %, about 37 mol %, about 38 mol %, or about 39 mol % (or any fraction thereof or the range therein) of the total lipid present in the lipid formulation.

In some embodiments, the total of helper lipid in the formulation comprises two or more helper lipids and the total amount of helper lipid comprises from about 20 mol % to about 50 mol %, from about 22 mol % to about 48 mol %, from about 24 mol % to about 46 mol %, about 25 mol % to about 44 mol %, from about 26 mol % to about 42 mol %, from about 27 mol % to about 41 mol %, from about 28 mol % to about 40 mol %, or about 29 mol %, about 30 mol %, about 31 mol %, about 32 mol %, about 33 mol %, about 34 mol %, about 35 mol %, about 36 mol %, about 37 mol %, about 38 mol %, or about 39 mol % (or any fraction thereof or the range therein) of the total lipid present in the lipid formulation. In some embodiments, the helper lipids are a combination of DSPC and DOTAP. In some embodiments, the helper lipids are a combination of DSPC and DOTMA.

The cholesterol or cholesterol derivative in the lipid formulation may comprise up to about 40 mol %, about 45 mol %, about 50 mol %, about 55 mol %, or about 60 mol % of the total lipid present in the lipid formulation. In some embodiments, the cholesterol or cholesterol derivative comprises about 15 mol % to about 45 mol %, about 20 mol % to about 40 mol %, about 30 mol % to about 40 mol %, or about 35 mol %, about 36 mol %, about 37 mol %, about 38 mol %, about 39 mol %, or about 40 mol % of the total lipid present in the lipid formulation.

The percentage of helper lipid present in the lipid formulation is a target amount, and the actual amount of helper lipid present in the formulation may vary, for example, by ±5 mol %.

A lipid formulation containing a cationic lipid compound or ionizable cationic lipid compound may be on a molar basis about 20-40% cationic lipid compound, about 25-40% cholesterol, about 25-50% helper lipid, and about 0.5-5% of a polyethylene glycol (PEG) lipid, wherein the percent is of the total lipid present in the formulation. In some embodiments, the composition is about 22-30% cationic lipid compound, about 30-40% cholesterol, about 30-40% helper lipid, and about 0.5-3% of a PEG-lipid, wherein the percent is of the total lipid present in the formulation.

Livid Conjugates

The lipid formulations described herein may further comprise a lipid conjugate. The conjugated lipid is useful for preventing the aggregation of particles. Suitable conjugated lipids include, but are not limited to, PEG-lipid conjugates, cationic-polymer-lipid conjugates, and mixtures thereof. Furthermore, lipid delivery vehicles can be used for specific targeting by attaching ligands (e.g., antibodies, peptides, and carbohydrates) to its surface or to the terminal end of the attached PEG chains (Front. Pharmacol. 2015 Dec. 1; 6:286).

In a preferred embodiment, the lipid conjugate is a PEG-lipid. The inclusion of polyethylene glycol (PEG) in a lipid formulation as a coating or surface ligand, a technique referred to as PEGylation, helps protect nanoparticles from the immune system and their escape from RES uptake (Nanomedicine (Lond). 2011 June; 6(4):715-28). PEGylation has been widely used to stabilize lipid formulations and their payloads through physical, chemical, and biological mechanisms. Detergent-like PEG lipids (e.g., PEG-DSPE) can enter the lipid formulation to form a hydrated layer and steric barrier on the surface. Based on the degree of PEGylation, the surface layer can be generally divided into two types, brush-like and mushroom-like layers. For PEG-DSPE-stabilized formulations, PEG will take on the mushroom conformation at a low degree of PEGylation (usually less than 5 mol %) and will shift to brush conformation as the content of PEG-DSPE is increased past a certain level (J. Nanomaterials. 2011; 2011:12). It has been shown that increased PEGylation leads to a significant increase in the circulation half-life of lipid formulations (Annu. Rev. Biomed. Eng. 2011 Aug. 15; 13( ):507-30; J. Control Release. 2010 Aug. 3; 145(3):178-81).

Suitable examples of PEG-lipids include, but are not limited to, PEG coupled to dialkyloxypropyls (PEG-DAA), PEG coupled to diacylglycerol (PEG-DAG), PEG coupled to phospholipids such as phosphatidylethanolamine (PEG-PE), PEG conjugated to ceramides, PEG conjugated to cholesterol or a derivative thereof, and mixtures thereof.

PEG is a linear, water-soluble polymer of ethylene PEG repeating units with two terminal hydroxyl groups. PEGs are classified by their molecular weights and include the following: monomethoxypolyethylene glycol (MePEG-OH), monomethoxypolyethylene glycol-succinate (MePEG-S), monomethoxypolyethylene glycol-succinimidyl succinate (MePEG-S-NHS), monomethoxypolyethylene glycol-amine (MePEG-$NH_2$), monomethoxypolyethylene glycol-tresylate (MePEG-TRES), monomethoxypolyethylene glycol-imidazolyl-carbonyl (MePEG-IM), as well as such compounds containing a terminal hydroxyl group instead of a terminal methoxy group (e.g., HO-PEG-S, HO-PEG-S—NHS, HO-PEG-$NH_2$).

The PEG moiety of the PEG-lipid conjugates described herein may comprise an average molecular weight ranging from about 550 daltons to about 10,000 daltons. In certain instances, the PEG moiety has an average molecular weight of from about 750 daltons to about 5,000 daltons (e.g., from about 1,000 daltons to about 5,000 daltons, from about 1,500 daltons to about 3,000 daltons, from about 750 daltons to about 3,000 daltons, from about 750 daltons to about 2,000 daltons). In preferred embodiments, the PEG moiety has an average molecular weight of about 2,000 daltons or about 750 daltons. The average molecular weight may be any value or subvalue within the recited ranges, including endpoints.

In certain instances, the PEG monomers can be optionally substituted by an alkyl, alkoxy, acyl, or aryl group. The PEG can be conjugated directly to the lipid or may be linked to the lipid via a linker moiety. Any linker moiety suitable for coupling the PEG to a lipid can be used including, e.g., non-ester-containing linker moieties and ester-containing linker moieties. In a preferred embodiment, the linker moiety is a non-ester-containing linker moiety. Suitable non-ester-containing linker moieties include, but are not limited to, amido (—C(O)NH—), amino (—NR— carbonyl (—C(O)—), carbamate (—NHC(O)O—), urea (—NHC(O)NH—), disulfide (—S—S—), ether (—O—), succinyl (—(O)$CCH_2CH_2C$(O)—), succinamidyl (—NHC(O)$CH_2CH_2C$(O)NH—), ether, as well as combinations thereof (such as a linker containing both a carbamate linker moiety and an amido linker moiety). In a preferred embodiment, a carbamate linker is used to couple the PEG to the lipid.

In other embodiments, an ester-containing linker moiety is used to couple the PEG to the lipid. Suitable ester-containing linker moieties include, e.g., carbonate (—OC(O)O—), succinoyl, phosphate esters (—O—(O)POH—O—), sulfonate esters, and combinations thereof.

Phosphatidylethanolamines having a variety of acyl chain groups of varying chain lengths and degrees of saturation can be conjugated to PEG to form the lipid conjugate. Such phosphatidylethanolamines are commercially available or can be isolated or synthesized using conventional techniques known to those of skill in the art. Phosphatidylethanolamines containing saturated or unsaturated fatty acids with carbon chain lengths in the range of $C_{10}$ to $C_{20}$ are preferred. Phosphatidylethanolamines with mono- or di-unsaturated fatty acids and mixtures of saturated and unsaturated fatty acids can also be used. Suitable phosphatidylethanolamines include, but are not limited to, dimyristoyl-phosphatidylethanolamine (DMPE), dipalmitoyl-phosphatidylethanolamine (DPPE), dioleoyl-phosphatidylethanolamine (DOPE), and distearoyl-phosphatidylethanolamine (DSPE).

In some embodiments, the PEG-DAA conjugate is a PEG-didecyloxypropyl ($C_{10}$) conjugate, a PEG-dilauryloxypropyl ($C_{12}$) conjugate, a PEG-dimyristyloxypropyl ($C_{14}$) conjugate, a PEG-dipalmityloxypropyl ($C_{16}$) conjugate, or a PEG-distearyloxypropyl ($C_{18}$) conjugate. In these embodiments, the PEG preferably has an average molecular weight of about 750 to about 2,000 daltons. In particular embodiments, the terminal hydroxyl group of the PEG is substituted with a methyl group.

In addition to the foregoing, other hydrophilic polymers can be used in place of PEG. Examples of suitable polymers that can be used in place of PEG include, but are not limited to, polyvinylpyrrolidone, polymethyloxazoline, polyethyloxazoline, polyhydroxypropyl, methacrylamide, polymethacrylamide, and poly dimethylacrylamide, polylactic acid, polyglycolic acid, and derivatized celluloses such as hydroxymethylcellulose or hydroxyethylcellulose.

In some embodiments, the lipid conjugate (e.g., PEG-lipid) comprises from about 0.1 mol % to about 2 mol %, from about 0.5 mol % to about 2 mol %, from about 1 mol % to about 2 mol %, from about 0.6 mol % to about 1.9 mol %, from about 0.7 mol % to about 1.8 mol %, from about 0.8 mol % to about 1.7 mol %, from about 0.9 mol % to about 1.6 mol %, from about 0.9 mol % to about 1.8 mol %, from about 1 mol % to about 1.8 mol %, from about 1 mol % to about 1.7 mol %, from about 1.2 mol % to about 1.8 mol %, from about 1.2 mol % to about 1.7 mol %, from about 1.3 mol % to about 1.6 mol %, or from about 1.4 mol % to about 1.6 mol % (or any fraction thereof or range therein) of the total lipid present in the lipid formulation. In other embodiments, the lipid conjugate (e.g., PEG-lipid) comprises about 0.5%, 0.6%, 0.7%, 0.8%, 0.9%, 1.0%, 1.2%, 1.3%, 1.4%, 1.5%, 1.6%, 1.7%, 1.8%, 1.9%, 2.0%, 2.5%, 3.0%, 3.5%, 4.0%, 4.5%, or 5%, (or any fraction thereof or range therein) of the total lipid present in the lipid formulation. The amount may be any value or subvalue within the recited ranges, including endpoints.

In some preferred embodiments, the PEG-lipid is PEG550-PE. In some preferred embodiments, the PEG-lipid is PEG750-PE. In some preferred embodiments, the PEG-lipid is PEG2000-DMG The percentage of lipid conjugate (e.g., PEG-lipid) present in the lipid formulations of the disclosure is a target amount, and the actual amount of lipid conjugate present in the formulation may vary, for example, by +0.5 mol %. One of ordinary skill in the art will appreciate that the concentration of the lipid conjugate can be varied depending on the lipid conjugate employed and the rate at which the lipid formulation is to become fusogenic.

Mechanism of Action for Cellular Uptake of Lipid Formulations

Lipid formulations for the intracellular delivery of nucleic acids, particularly liposomes, cationic liposomes, and lipid nanoparticles, are designed for cellular uptake by penetrating target cells through exploitation of the target cells' endocytic mechanisms where the contents of the lipid delivery vehicle are delivered to the cytosol of the target cell. (Nucleic Acid Therapeutics, 28(3):146-157, 2018). Specifically, in the case of a CFTR mRNA-lipid formulation described herein, the mRNA-lipid formulation enters lung epithelial cells through receptor mediated endocytosis. Prior to endocytosis, functionalized ligands such as PEG-lipid at the surface of the lipid delivery vehicle are shed from the surface, which triggers internalization into the target cell. During endocytosis, some part of the plasma membrane of the cell surrounds the vector and engulfs it into a vesicle that then pinches off from the cell membrane, enters the cytosol and ultimately undergoes the endolysosomal pathway. For ionizable cationic lipid-containing delivery vehicles, the increased acidity as the endosome ages results in a vehicle with a strong positive charge on the surface. Interactions between the delivery vehicle and the endosomal membrane then result in a membrane fusion event that leads to cytosolic delivery of the payload. For mRNA payloads, the cell's own internal translation processes will then translate the mRNA into the encoded protein. The encoded protein can further undergo post-translational processing, including transportation to a targeted organelle or location within the cell. In the case of a CFTR protein, the CFTR protein is translocated to the cellular membrane.

By controlling the composition and concentration of the lipid conjugate, one can control the rate at which the lipid conjugate exchanges out of the lipid formulation and, in turn, the rate at which the lipid formulation becomes fusogenic. In addition, other variables including, e.g., pH, temperature, or ionic strength, can be used to vary and/or control the rate at which the lipid formulation becomes fusogenic. Other methods which can be used to control the rate at which the lipid formulation becomes fusogenic will become apparent to those of skill in the art upon reading this disclosure. Also, by controlling the composition and concentration of the lipid conjugate, one can control the liposomal or lipid particle size.

Lipid Formulation Manufacture

There are many different methods for the preparation of lipid formulations comprising a nucleic acid. (Curr. Drug Metabol. 2014, 15, 882-892; Chem. Phys. Lipids 2014, 177, 8-18; Int. J. Pharm. Stud. Res. 2012, 3, 14-20). The techniques of thin film hydration, double emulsion, reverse phase evaporation, microfluidic preparation, dual asymmetric centrifugation, ethanol injection, detergent dialysis, spontaneous vesicle formation by ethanol dilution, and encapsulation in preformed liposomes are briefly described herein.

Thin Film Hydration

In Thin Film Hydration (TFH) or the Bangham method, the lipids are dissolved in an organic solvent, then evaporated through the use of a rotary evaporator leading to a thin lipid layer formation. After the layer hydration by an aqueous buffer solution containing the compound to be loaded, Multilamellar Vesicles (MLVs) are formed, which can be reduced in size to produce Small or Large Unilamellar vesicles (LUV and SUV) by extrusion through membranes or by the sonication of the starting MLV.

Double Emulsion

Lipid formulations can also be prepared through the Double Emulsion technique, which involves lipids dissolution in a water/organic solvent mixture. The organic solution, containing water droplets, is mixed with an excess of aqueous medium, leading to a water-in-oil-in-water (W/O/W) double emulsion formation. After mechanical vigorous shaking, part of the water droplets collapse, giving Large Unilamellar Vesicles (LUVs).

Reverse Phase Evaporation

The Reverse Phase Evaporation (REV) method also allows one to achieve LUVs loaded with nucleic acid. In this technique a two-phase system is formed by phospholipids dissolution in organic solvents and aqueous buffer. The resulting suspension is then sonicated briefly until the mixture becomes a clear one-phase dispersion. The lipid formulation is achieved after the organic solvent evaporation under reduced pressure. This technique has been used to encapsulate different large and small hydrophilic molecules including nucleic acids.

Microfluidic Preparation

The Microfluidic method, unlike other bulk techniques, gives the possibility of controlling the lipid hydration process. The method can be classified in continuous-flow microfluidic and droplet-based microfluidic, according to the way in which the flow is manipulated. In the microfluidic hydrodynamic focusing (MHF) method, which operates in a continuous flow mode, lipids are dissolved in isopropyl alcohol which is hydrodynamically focused in a microchannel cross junction between two aqueous buffer streams. Vesicles size can be controlled by modulating the flow rates, thus controlling the lipids solution/buffer dilution process. The method can be used for producing oligonucleotide (ON) lipid formulations by using a microfluidic device consisting of three-inlet and one-outlet ports.

Dual Asymmetric Centrifugation

Dual Asymmetric Centrifugation (DAC) differs from more common centrifugation as it uses an additional rotation around its own vertical axis. An efficient homogenization is achieved due to the two overlaying movements generated: the sample is pushed outwards, as in a normal centrifuge, and then it is pushed towards the center of the vial due to the additional rotation. By mixing lipids and an NaCl-solution a viscous vesicular phospholipid gel (VPC) is achieved, which is then diluted to obtain a lipid formulation dispersion. The lipid formulation size can be regulated by optimizing DAC speed, lipid concentration and homogenization time.

Ethanol Injection

The Ethanol Injection (EI) method can be used for nucleic acid encapsulation. This method provides the rapid injection of an ethanolic solution, in which lipids are dissolved, into an aqueous medium containing nucleic acids to be encapsulated, through the use of a needle. Vesicles are spontaneously formed when the phospholipids are dispersed throughout the medium.

Detergent Dialysis

The Detergent dialysis method can be used to encapsulate nucleic acids. Briefly lipid and plasmid are solubilized in a detergent solution of appropriate ionic strength, after removing the detergent by dialysis, a stabilized lipid formulation is formed. Unencapsulated nucleic acid is then removed by ion-exchange chromatography and empty vesicles by sucrose density gradient centrifugation. The technique is highly sensitive to the cationic lipid content and to the salt concentration of the dialysis buffer, and the method is also difficult to scale.

Spontaneous Vesicle Formation by Ethanol Dilution

Stable lipid formulations can also be produced through the Spontaneous Vesicle Formation by Ethanol Dilution method in which a stepwise or dropwise ethanol dilution provides the instantaneous formation of vesicles loaded with nucleic acid by the controlled addition of lipid dissolved in ethanol to a rapidly mixing aqueous buffer containing the nucleic acid.

Encapsulation in Preformed Liposomes

The entrapment of nucleic acids can also be obtained starting with preformed liposomes through two different methods: (1) a simple mixing of cationic liposomes with nucleic acids which gives electrostatic complexes called "lipoplexes", where they can be successfully used to transfect cell cultures, but are characterized by their low encapsulation efficiency and poor performance in vivo; and (2) a liposomal destabilization, slowly adding absolute ethanol to a suspension of cationic vesicles up to a concentration of 40% v/v followed by the dropwise addition of nucleic acids achieving loaded vesicles; however, the two main steps characterizing the encapsulation process are too sensitive, and the particles have to be downsized.

CFTR mRNA Lipid Formulations

The present disclosure provides for lipid formulations comprising a mRNA encoding an enzyme having Cystic Fibrosis Transmembrane Conductance Regulator (CFTR) activity (CFTR mRNA). Following transfection of one or more target cells by the CFTR mRNA lipid formulations of the present disclosure, expression of the CFTR enzyme encoded by such mRNA will be stimulated and the capability of such target cells to express the CFTR enzyme is enhanced. The CFTR mRNA can be any suitable mRNA for expressing a CFTR enzyme in vivo.

In a first CFTR mRNA-lipid formulation, a CFTR mRNA-lipid formulation comprises a compound of Formula (I) and an mRNA encoding an enzyme having CFTR activity. In some embodiments the mRNA encodes a CFTR enzyme consisting of a sequence having 95% identity to SEQ ID NO: 93. In some embodiments, the mRNA encodes a CFTR enzyme consisting of SEQ ID NO: 93. In some embodiments the mRNA encodes a CFTR enzyme consisting of a sequence having 95% identity to SEQ ID NO: 99. In some embodiments, the mRNA encodes an CFTR enzyme consisting of SEQ ID NO: 99. The compound of Formula I can be selected based on desirable properties including its lipophilicity, potency, selectivity for a specific target cell, in vivo biodegradability, toxicity and immunogenicity profile, and the pKa of the ionizable/protonatable group on the compound of Formula I.

In some embodiments of the first CFTR mRNA-lipid formulation, $X^7$ is S. In some embodiments, $X^5$ is —C(O)O—, whereby —C(O)O—$R^6$ is formed and $X^6$ is —C(O)O— whereby —C(O)O—$R^5$ is formed. In some embodiments, $R^7$ and $R^8$ are each independently selected from the group consisting of methyl, ethyl and isopropyl. In some embodiments, $L^5$ and $L^6$ are each independently a $C_1$-$C_{10}$ alkyl. In some embodiments, $L^5$ is $C_1$-$C_3$ alkyl, and $L^6$ is $C_1$-$C_5$ alkyl. In some embodiments, $L^6$ is $C_1$-$C_2$ alkyl. In some embodiments, $L^5$ and $L^6$ are each a linear $C_7$ alkyl. In some embodiments, $L^5$ and $L^6$ are each a linear $C_9$ alkyl. In some embodiments, $R^5$ and $R^6$ are each independently an alkenyl. In some embodiments, $R^6$ is alkenyl. In some embodiments, $R^6$ is $C_2$-$C_9$ alkenyl. In some embodiments, the alkenyl comprises a single double bond. In some embodiments, $R^5$ and $R^6$ are each alkyl. In some embodiments, $R^5$ is a branched alkane. In some embodiments, $R^5$ and $R^6$ are each independently selected from the group consisting of a $C_9$ alkyl, $C_9$ alkenyl and $C_9$ alkynyl. In some embodiments, $R^5$ and $R^6$ are each independently selected from the group consisting of a $C_{11}$ alkyl, $C_{11}$ alkenyl and $C_{11}$ alkynyl. In some embodiments, $R^5$ and $R^6$ are each independently selected from the group consisting of a $C_7$ alkyl, $C_7$ alkenyl and $C_7$ alkynyl. In some embodiments, $R^5$ is —$CH((CH_2)_pCH_3)_2$ or —$CH((CH_2)_pCH_3)((CH_2)_{p-1}CH_3)$, wherein p is 4-8. In some embodiments, p is 5 and $L^5$ is a $C_1$-$C_3$ alkyl. In some embodiments, p is 6 and $L^5$ is a $C_3$ alkyl. In some embodiments, p is 7. In some embodiments, p is 8 and $L^5$ is a $C_1$-$C_3$ alkyl. In some embodiments, $R^5$ consists of —$CH((CH_2)_pCH_3)((CH_2)_{p-1}CH_3)$, wherein p is 7 or 8. In some embodiments, $R^4$ is ethylene or propylene. In some embodiments, $R^4$ is n-propylene or isobutylene. In some embodiments, $L^7$ is absent, $R^4$ is ethylene, $X^7$ is S and $R^7$ and $R^8$ are each methyl. In some embodiments, $L^7$ is absent, $R^4$ is n-propylene, $X^7$ is S and $R^7$ and $R^8$ are each methyl. In some embodiments, $L^7$ is absent, $R^4$ is ethylene, $X^7$ is S and $R^7$ and $R^8$ are each ethyl.

In some embodiments of the first CFTR mRNA-lipid formulation, $X^7$ is S, $X^5$ is —C(O)O—, whereby —C(O)O—$R^6$ is formed and $X^6$ is —C(O)O—, whereby —C(O)O—$R^5$ is formed, $L^5$ and $L^6$ are each independently a linear $C_3$-$C_7$ alkyl $L^7$ is absent, $R^5$ is —$CH((CH_2)_pCH_3)_2$, and $R^6$ is $C_7$-$C_{12}$ alkenyl. In some further embodiments, p is 6 and $R^6$ is $C_9$ alkenyl.

Any mRNA encoding an enzyme having CFTR activity is suitable for inclusion in the first CFTR mRNA-lipid formulation of the present disclosure. In some embodiments, a suitable mRNA is a wild-type human CFTR mRNA of sequence SEQ ID NO: 93. Preferably, the CFTR mRNA has low immunogenicity, high in vivo stability, and high translation efficiency. In some embodiments, the CFTR mRNA is expressible in human lung epithelial cells. In some embodiments, the CFTR mRNA has a coding region that is codon-optimized. In some embodiments, the CFTR mRNA comprises modified uridine nucleotides. In some embodiments, the modified uridine nucleotides are $N^1$-methylpseudouridine or 5-methoxyuridine. In some embodiments, the modified uridine nucleotides are 5-methoxyuridine. In some embodiments, the CFTR mRNA can be any of the CFTR mRNA constructs described herein.

In some embodiments of the first CFTR mRNA-lipid formulation, the mRNA comprises an open reading frame (ORF or coding region) selected from a sequence comprising SEQ ID NOs: 100-105. In some embodiments, the mRNA comprises an ORF having a sequence of SEQ ID NO: 100. In some embodiments, the mRNA comprises an ORF having a sequence of SEQ ID NO: 101. In some embodiments, the mRNA comprises an ORF having a sequence of SEQ ID NO: 102. In some embodiments, the mRNA comprises an ORF having a sequence of SEQ ID NO: 103. In some embodiments, the mRNA comprises an ORF having a sequence of SEQ ID NO: 104. In some embodiments, the mRNA comprises an ORF having a sequence of SEQ ID NO: 105. In some embodiments, the mRNA comprises a sequence having about 85% identity to a sequence selected from SEQ ID NOs: 49, 53, 66, 68, 69, and 72. In some embodiments, the mRNA comprises a sequence having about 90% identity to a sequence selected from SEQ ID NOs: 49, 53, 66, 68, 69, and 72. In some embodiments, the mRNA comprises a sequence having about 95% identity to a sequence selected from SEQ ID NOs: 49, 53, 66, 68, 69, and 72. In some embodiments, the mRNA comprises a sequence having about 96% identity to a sequence selected from SEQ ID NOs: 49, 53, 66, 68, 69, and 72. In some embodiments, the mRNA comprises a sequence having about 97% identity to a sequence selected from SEQ ID NOs: 49, 53, 66, 68, 69, and 72. In some embodiments, the mRNA comprises a sequence having about 98% identity to a sequence selected from SEQ ID NOs: 49, 53, 66, 68, 69, and 72. In some embodiments, the mRNA comprises a sequence having about 99% identity to a sequence selected from SEQ ID NOs: 49, 53, 66, 68, 69, and 72. In some embodiments, the mRNA comprises a sequence having about 99.5% identity to a sequence selected from SEQ ID NOs: 49, 53, 66, 68, 69, and 72. In some embodiments, the mRNA comprises a sequence selected from SEQ ID NOS: 49, 53, 66, 68, 69, and 72. In some embodiments, the mRNA comprises a sequence having SEQ ID NO: 49. In some embodiments, the mRNA comprises a sequence having SEQ ID NO: 53. In some embodiments, the mRNA comprises a sequence having SEQ ID NO: 66. In some embodiments, the mRNA comprises a sequence having SEQ ID NO: 68. In some embodiments, the mRNA comprises a sequence having SEQ ID NO: 69. In some embodiments, the mRNA comprises a sequence having SEQ ID NO: 72.

In any of the embodiments of the first CFTR mRNA-lipid formulation, the CFTR mRNA-lipid formulation comprises lipid nanoparticles. In some embodiments, the lipid nanoparticles completely encapsulate the CFTR mRNA.

In some embodiments, the lipid nanoparticles have an average particle size of less than about 100 nm. In some embodiments, the lipid nanoparticles have an average particles size of about 55 to about 85 nm. In some embodiments, the lipid nanoparticles encapsulate at least about 50% of the mRNA. In some embodiments, the lipid nanoparticles encapsulate at least about 85% of the mRNA. In some embodiments, the lipid nanoparticles have greater than about 90% encapsulation efficiency. In some embodiments, the lipid nanoparticles have greater than about 95% encapsulation efficiency.

In a second CFTR mRNA-lipid formulation, a CFTR mRNA-lipid formulation comprises the ionizable cationic lipid

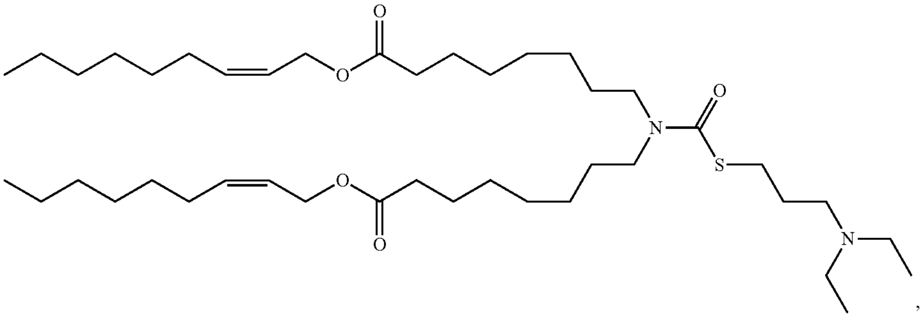 [SMILES: CCCCCC/C=C\COC(=O)CCCCCCCN(CCCCCCCC(=O)OC/C=C\CCCCCC)C(=O)SCCCN(CC)CC]

, or a pharmaceutically acceptable salt thereof and an mRNA encoding an enzyme having CFTR activity.

Any mRNA encoding an enzyme having CFTR activity is suitable for inclusion in the second CFTR mRNA-lipid formulation of the present disclosure. In some embodiments, a suitable mRNA is a wild-type human CFTR mRNA encoding a protein of SEQ ID NO: 93. In some embodiments the mRNA encodes a CFTR enzyme consisting of a sequence having 95% identity to SEQ ID NO: 93. In some embodiments, the mRNA encodes a CFTR enzyme consisting of SEQ ID NO: 93. In some embodiments the mRNA encodes a CFTR enzyme consisting of a sequence having 95% identity to SEQ ID NO: 99. In some embodiments, the mRNA encodes a CFTR enzyme consisting of SEQ ID NO: 99. Preferably, the CFTR mRNA has low immunogenicity, high in vivo stability, and high translation efficiency. In some embodiments, the CFTR mRNA is expressible in human lung epithelial cells. In some embodiments, the CFTR mRNA has a coding region that is codon-optimized. In some embodiments, the CFTR mRNA comprises modified uridine nucleotides. In some embodiments, the modified uridine nucleotides are $N^1$-methylpseudouridine or 5-methoxyuridine. In some embodiments, the modified uridine nucleotides are 5-methoxyuridine. In some embodiments, the modified uridine nucleotides are $N^1$-methylpseudouridine. In some embodiments, the CFTR mRNA can be any of the CFTR mRNA constructs described herein.

In some embodiments of the second CFTR mRNA-lipid formulation, the mRNA comprises an open reading frame (ORF or coding region) selected from a sequence comprising SEQ ID NOs: 100-105. In some embodiments, the mRNA comprises an ORF having a sequence of SEQ ID NO: 100. In some embodiments, the mRNA comprises an ORF having a sequence of SEQ ID NO: 101. In some embodiments, the mRNA comprises an ORF having a sequence of SEQ ID NO: 102. In some embodiments, the mRNA comprises an ORF having a sequence of SEQ ID NO: 103. In some embodiments, the mRNA comprises an ORF having a sequence of SEQ ID NO: 104. In some embodiments, the mRNA comprises an ORF having a sequence of SEQ ID NO: 105. In some embodiments, the mRNA comprises a sequence having about 85% identity to a sequence selected from SEQ ID NOs: 49, 53, 66, 68, 69, and 72. In some embodiments, the mRNA comprises a sequence having about 90% identity to a sequence selected from SEQ ID NOs: 49, 53, 66, 68, 69, and 72. In some embodiments, the mRNA comprises a sequence having about 95% identity to a sequence selected from SEQ ID NOs: 49, 53, 66, 68, 69, and 72. In some embodiments, the mRNA comprises a sequence having about 96% identity to a sequence selected from SEQ ID NOs: 49, 53, 66, 68, 69, and 72. In some embodiments, the mRNA comprises a sequence having about 97% identity to a sequence selected from SEQ ID NOs: 49, 53, 66, 68, 69, and 72. In some embodiments, the mRNA comprises a sequence having about 98% identity to a sequence selected from SEQ ID NOs: 49, 53, 66, 68, 69, and 72. In some embodiments, the mRNA comprises a sequence having about 99% identity to a sequence selected from SEQ ID NOs: 49, 53, 66, 68, 69, and 72. In some embodiments, the mRNA comprises a sequence having about 99.5% identity to a sequence selected from SEQ ID NOs: 49, 53, 66, 68, 69, and 72. In some embodiments, the mRNA comprises a sequence selected from SEQ ID NOS: 49, 53, 66, 68, 69, and 72. In some embodiments, the mRNA comprises a sequence having SEQ ID NO: 49. In some embodiments, the mRNA comprises a sequence having SEQ ID NO: 53. In some embodiments, the mRNA comprises a sequence having SEQ ID NO: 66. In some embodiments, the mRNA comprises a sequence having SEQ ID NO: 68. In some embodiments, the mRNA comprises a sequence having SEQ ID NO: 69. In some embodiments, the mRNA comprises a sequence having SEQ ID NO: 72.

In any of the embodiments of the second CFTR mRNA-lipid formulation, the CFTR mRNA-lipid formulation comprises lipid nanoparticles. In some embodiments, the lipid nanoparticles completely encapsulate the CFTR mRNA.

In some embodiments, the lipid nanoparticles have an average particle size of less than about 100 nm. In some embodiments, the lipid nanoparticles have an average particles size of about 55 nm to about 85 nm. In some embodiments, the lipid nanoparticles encapsulate at least about 50% of the mRNA. In some embodiments, the lipid nanoparticles encapsulate at least about 85% of the mRNA. In some embodiments, the lipid nanoparticles have greater than about 90% encapsulation efficiency.

In some embodiments, either the first or second CFTR mRNA-lipid formulation further comprises a helper lipid. In some embodiments, the helper lipid is selected from the group consisting of neutral and anionic lipids. In some embodiments, the helper lipid is selected from the group consisting of dipalmitoyl phosphatidylcholine (DPPC), phosphatidylcholine (PC), dioleoylphosphatidyl ethanolamine (DOPE), dimyristoylphosphatidyl choline (DMPC), distearoylphosphatidyl choline, and dimyristoylphosphatidyl glycerol (DMPG). In some embodiments, the non-cationic lipid is distearoylphosphatidylcholine (DSPC).

In some embodiments, either the first or second CFTR mRNA-lipid formulation further comprises cholesterol.

In some embodiments, either the first or second CFTR mRNA-lipid formulation further comprises a polyethylene glycol (PEG)-lipid conjugate. In some embodiments, the PEG-lipid conjugate is PEG-DMG. In some embodiments, the PEG-DMG is PEG2000-DMG.

In some embodiments, the lipid portion (meaning the total amount of lipids in the formulation) of either the first or second CFTR mRNA-lipid formulation comprises about 48 mol % to about 66 mol % of the cationic lipid, about 2 mol % to about 12 mol % DSPC, about 25 mol % to about 42 mol % cholesterol, and about 0.5 mol % to about 3 mol % PEG2000-DMG.

In some embodiments, the lipid portion of either the first or second CFTR mRNA-lipid formulation comprises about 55 mol % to about 61 mol % of the cationic lipid, about 5 mol % to about 9 mol % DSPC, about 29 mol % to about 38 mol % cholesterol, and about 1 mol % to about 2 mol % PEG2000-DMG.

In some embodiments, the lipid portion of either the first or second CFTR mRNA-lipid formulation comprises about 56 mol % to about 60 mol % of the cationic lipid, about 6 mol % to about 8 mol % DSPC, about 31 mol % to about 34 mol % cholesterol, and about 1.25 mol % to about 1.75 mol % PEG2000-DMG.

In some embodiments, either the first or second CFTR mRNA-lipid formulation has a total lipid:mRNA weight ratio of about 50:1 to about 10:1. In some embodiments, either the first or second CFTR mRNA-lipid formulation has a total lipid:mRNA weight ratio of about 40:1 to about 20:1. In some embodiments, either the first or second CFTR mRNA-lipid formulation has a total lipid:mRNA weight ratio of about 35:1 to about 25:1. In some embodiments, either the first or second CFTR mRNA-lipid formulation has a total lipid:mRNA weight ratio of about 28:1 to about 32:1. In some embodiments, either the first or second CFTR mRNA-lipid formulation has a total lipid:mRNA weight ratio of about 29:1 to about 31:1.

Pharmaceutical Compositions and Delivery Methods

To facilitate expression of mRNA in vivo, the nucleic acid lipid formulation delivery vehicles described herein can be combined with one or more additional nucleic acids, carriers, targeting ligands or stabilizing reagents, or in pharmacological compositions where it is mixed with suitable excipients. Techniques for formulation and administration of drugs may be found in "Remington's Pharmaceutical Sciences," Mack Publishing Co., Easton, Pa., latest edition. Preferably, the nucleic acid lipid formulation is a CFTR mRNA-lipid nanoparticle formulation as described herein. Preferably, the mRNA encodes a human CFTR protein of SEQ ID NOs: 93 or 99, preferably formulated in a lipid delivery system or lipid carrier and preferably comprising pharmaceutically acceptable excipients. In some embodiments, the pharmaceutical composition further comprises pharmaceutically acceptable excipients. Pharmaceutical compositions disclosed herein preferably facilitate expression of CFTR mRNA in vivo.

The lipid formulations and pharmaceutical compositions of the present disclosure may be administered and dosed in accordance with current medical practice, taking into account the clinical condition of the subject, the site and method of administration, the scheduling of administration, the subject's age, sex, body weight and other factors relevant to clinicians of ordinary skill in the art. The "effective amount" for the purposes herein may be determined by such relevant considerations as are known to those of ordinary skill in experimental clinical research, pharmacological, clinical and medical arts. In some embodiments, the amount administered is effective to achieve at least some stabilization, improvement or elimination of symptoms and other indicators as are selected as appropriate measures of disease progress, regression or improvement by those of skill in the art. For example, a suitable amount and dosing regimen is one that causes at least transient protein (e.g., enzyme) production.

The pharmaceutical compositions described herein can achieve expression of a CFTR protein in the lung epithelial cells of a subject. Suitable routes of administration include, for example, intratracheal, inhaled, or intranasal. In some embodiments, the administration results in delivery of the mRNA to a lung epithelial cell. In some embodiments, the administration shows a selectivity towards lung epithelial cells over other types of lung cells and cells of the airways.

The pharmaceutical compositions disclosed herein can be formulated using one or more excipients to: (1) increase stability; (2) increase cell transfection; (3) permit a sustained or delayed release (e.g., from a depot formulation of the polynucleotide, primary construct, or mRNA); (4) alter the biodistribution (e.g., target the polynucleotide, primary construct, or mRNA to specific tissues or cell types); (5) increase the translation of encoded protein in vivo; and/or (6) alter the release profile of encoded protein in vivo.

Preferably, mRNAs and lipid formulations thereof may be administered in a local rather than systemic manner. Local delivery can be affected in various ways, depending on the tissue to be targeted. For example, aerosols containing compositions of the present disclosure can be inhaled (for nasal, tracheal, or bronchial delivery).

Pharmaceutical compositions may be administered to any desired tissue. In some embodiments, the CFTR mRNA delivered by a lipid formulation or composition of the present disclosure is expressed in the tissue in which the lipid formulation and/or composition was administered. In some embodiments, the mRNA delivered is expressed in a tissue different from the tissue in which the lipid formulation and/or composition was administered. Example tissues in which delivered mRNA may be delivered and/or expressed include, but are not limited to the lung, trachea, and/or nasal passages.

The pharmaceutical compositions described herein may be prepared by any method known or hereafter developed in the art of pharmacology. In general, such preparatory methods include the step of associating the active ingredient (i.e., nucleic acid) with an excipient and/or one or more other accessory ingredients. A pharmaceutical composition in accordance with the present disclosure may be prepared, packaged, and/or sold in bulk, as a single unit dose, and/or as a plurality of single unit doses.

Pharmaceutical compositions may additionally comprise a pharmaceutically acceptable excipient, which, as used herein, includes, but is not limited to, any and all solvents, dispersion media, diluents, or other liquid vehicles, dispersion or suspension aids, surface active agents, isotonic agents, thickening or emulsifying agents, preservatives, and the like, as suited to the particular dosage form desired.

In addition to traditional excipients such as any and all solvents, dispersion media, diluents, or other liquid vehicles, dispersion or suspension aids, surface active agents, isotonic agents, thickening or emulsifying agents, preservatives, excipients of the present disclosure can include, without limitation, liposomes, lipid nanoparticles, polymers, lipoplexes, core-shell nanoparticles, peptides, proteins, cells transfected with primary DNA construct, or mRNA (e.g., for transplantation into a subject), hyaluronidase, nanoparticle mimics and combinations thereof.

Accordingly, the formulations described herein can include one or more excipients, each in an amount that together increases the stability of the nucleic acid in the lipid formulation, increases cell transfection by the nucleic acid (e.g., mRNA), increases the expression of the encoded protein, and/or alters the release profile of the encoded protein. Further, the mRNA of the present disclosure may be formulated using self-assembled nucleic acid nanoparticles.

Various excipients for formulating pharmaceutical compositions and techniques for preparing the composition are known in the art (see Remington: The Science and Practice of Pharmacy, 21st Edition, A. R. Gennaro, Lippincott, Williams & Wilkins, Baltimore, Md., 2006; incorporated herein by reference in its entirety). The use of a conventional excipient medium may be contemplated within the scope of the embodiments of the present disclosure, except insofar as any conventional excipient medium may be incompatible with a substance or its derivatives, such as by producing any undesirable biological effect or otherwise interacting in a deleterious manner with any other component(s) of the pharmaceutical composition.

A dosage form of the composition of this disclosure can be solid, which can be reconstituted in a liquid prior to administration. The solid can be administered as a powder. In some embodiments, the pharmaceutical composition comprises a nucleic acid lipid formulation that has been lyophilized.

In a preferred embodiment, the dosage form of the pharmaceutical compositions described herein can be a liquid suspension of CFTR mRNA lipid nanoparticles described herein. In some embodiments, the liquid suspension is in a buffered solution. In some embodiments, the buffered solution comprises a buffer selected from the group consisting of HEPES, MOPS, TES, and TRIS. In some embodiments, the buffer has a pH of about 7.4. In some preferred embodiments, the buffer is HEPES. In some further embodiments, the buffered solution further comprises a cryoprotectant. In some embodiments, the cryoprotectant is selected from a sugar and glycerol or a combination of a sugar and glycerol. In some embodiments, the sugar is a dimeric sugar. In some embodiments, the sugar is sucrose. In some preferred embodiments, the buffer comprises HEPES, sucrose, and glycerol at a pH of 7.4. In some embodiments, the suspension is frozen during storage and thawed prior to administration. In some embodiments, the suspension is frozen at a temperature below about −70° C. In some embodiments, the suspension is diluted with sterile water prior to inhalable administration. In some embodiments, inhalable administration comprises diluting the suspension with about 1 volume to about 4 volumes of sterile water. In some embodiments, a lyophilized CFTR-mRNA lipid nanoparticle formulation can be resuspended in a buffer as described herein.

The compositions and methods of the disclosure may be administered to subjects by a variety of mucosal administration modes, including intranasal and/or intrapulmonary. In some aspects of this disclosure, the mucosal tissue layer includes an epithelial cell layer. The epithelial cell can be pulmonary, tracheal, bronchial, alveolar, nasal, and/or buccal. Compositions of this disclosure can be administered using conventional actuators such as mechanical spray devices, as well as pressurized, electrically activated, or other types of actuators.

The mRNA compositions of this disclosure may be administered in an aqueous solution as a nasal or pulmonary spray and may be dispensed in spray form by a variety of methods known to those skilled in the art. Pulmonary delivery of a composition of this disclosure is achieved by administering the composition in the form of drops, particles, or spray, which can be, for example, aerosolized, atomized, or nebulized. Particles of the composition, spray, or aerosol can be in either a liquid or solid form, for example, a lyophilized lipid formulation. Preferred systems for dispensing liquids as a nasal spray are disclosed in U.S. Pat. No. 4,511,069. Such formulations may be conveniently prepared by dissolving compositions according to the present disclosure in water to produce an aqueous solution, and rendering said solution sterile. The formulations may be presented in multi-dose containers, for example in the sealed dispensing system disclosed in U.S. Pat. No. 4,511,069. Other suitable nasal spray delivery systems have been described in TRANSDERMAL SYSTEMIC MEDICATION, Y. W. Chien ed., Elsevier Publishers, New York, 1985; and in U.S. Pat. No. 4,778,810. Additional aerosol delivery forms may include, e.g., compressed air-, jet-, ultrasonic-, and piezoelectric nebulizers, which deliver the CFTR mRNA lipid formulation or suspended in a pharmaceutical solvent, e.g., water, ethanol, or mixtures thereof.

Nasal and pulmonary spray solutions of the present disclosure typically comprise the drug or drug to be delivered, optionally formulated with a surface-active agent, such as anonionic surfactant (e.g., polysorbate-80), and one or more buffers, provided that the inclusion of the surfactant does not disrupt the structure of the lipid formulation. In some embodiments of the present disclosure, the nasal spray solution further comprises a propellant. The pH of the nasal spray solution may be from pH 6.8 to 7.2. The pharmaceutical solvents employed can also be a slightly acidic aqueous buffer of pH 4-6. Other components may be added to enhance or maintain chemical stability, including preservatives, surfactants, dispersants, or gases.

In some embodiments, this disclosure provides a pharmaceutical product which includes a solution containing a composition of this disclosure and an actuator for a pulmonary, mucosal, or intranasal spray or aerosol.

A dosage form of the composition of this disclosure can be liquid, in the form of droplets or an emulsion, or in the form of an aerosol.

A dosage form of the composition of this disclosure can be solid, which can be reconstituted in a liquid prior to administration. The solid can be administered as a powder. The solid can be in the form of a capsule, tablet, or gel.

To formulate compositions for pulmonary delivery within the present disclosure, the CFTR mRNA lipid formulation can be combined with various pharmaceutically acceptable additives, as well as a base or carrier for dispersion of the CFTR mRNA lipid formulation(s). Examples of additives include pH control agents such as arginine, sodium hydroxide, glycine, hydrochloric acid, citric acid, and mixtures thereof. Other additives include local anesthetics (e.g., benzyl alcohol), isotonizing agents (e.g., sodium chloride, mannitol, sorbitol), adsorption inhibitors (e.g., Tween 80), solubility enhancing agents (e.g., cyclodextrins and derivatives thereof), stabilizers (e.g., serum albumin), and reducing agents (e.g., glutathione). When the composition for mucosal delivery is a liquid, the tonicity of the formulation, as measured with reference to the tonicity of 0.9% (w/v) physiological saline solution taken as unity, is typically adjusted to a value at which no substantial, irreversible tissue damage will be induced in the mucosa at the site of administration. Generally, the tonicity of the solution is adjusted to a value of ⅓ to 3, more typically ½ to 2, and most often ¾ to 1.7.

The CFTR mRNA lipid formulation may be dispersed in a base or vehicle, which may comprise a hydrophilic compound having a capacity to disperse the CFTR mRNA lipid formulation and any desired additives. The base may be selected from a wide range of suitable carriers, including but not limited to, copolymers of polycarboxylic acids or salts thereof, carboxylic anhydrides (e.g., maleic anhydride) with other monomers (e.g., methyl(meth)acrylate, acrylic acid, etc.), hydrophilic vinyl polymers such as polyvinyl acetate, polyvinyl alcohol, polyvinylpyrrolidone, cellulose derivatives such as hydroxymethylcellulose, hydroxypropylcellulose, etc., and natural polymers such as chitosan, collagen, sodium alginate, gelatin, hyaluronic acid, and nontoxic metal salts thereof. Often, a biodegradable polymer is selected as a base or carrier, for example, polylactic acid, poly(lactic acid-glycolic acid) copolymer, polyhydroxybutyric acid, poly(hydroxybutyric acid-glycolic acid) copolymer, and mixtures thereof. Alternatively or additionally, synthetic fatty acid esters such as polyglycerin fatty acid esters, sucrose fatty acid esters, etc., can be employed as carriers. Hydrophilic polymers and other carriers can be used alone or in combination and enhanced structural integrity can be imparted to the carrier by partial crystallization, ionic bonding, crosslinking, and the like. The carrier can be provided in a variety of forms, including fluid or viscous solutions, gels, pastes, powders, microspheres, and films for direct application to the nasal mucosa. The use of a selected carrier in this context may result in promotion of absorption of the CFTR mRNA lipid formulation.

The compositions of this disclosure may alternatively contain as pharmaceutically acceptable carriers substances as required to approximate physiological conditions, such as pH adjusting and buffering agents, tonicity adjusting agents, and wetting agents, for example, sodium acetate, sodium lactate, sodium chloride, potassium chloride, calcium chloride, sorbitan monolaurate, triethanolamine oleate, and mixtures thereof. For solid compositions, conventional nontoxic pharmaceutically acceptable carriers can be used which include, for example, pharmaceutical grades of mannitol, lactose, starch, magnesium stearate, sodium saccharin, talcum, cellulose, glucose, sucrose, magnesium carbonate, and the like.

In certain embodiments of the disclosure, the CFTR mRNA lipid formulation may be administered in a time release formulation, for example in a composition which includes a slow release polymer. The CFTR mRNA lipid formulation can be prepared with carriers that will protect against rapid release, for example a controlled release vehicle such as a polymer, microencapsulated delivery system, or a bioadhesive gel. Prolonged delivery of the CFTR mRNA lipid formulation, in various compositions of the disclosure can be brought about by including in the composition agents that delay absorption, for example, aluminum monostearate hydrogels and gelatin.

It has been demonstrated that nucleic acids can be delivered to the lungs by intratracheal administration of a liquid suspension of the nucleic acid composition and inhalation of an aerosol mist produced by a liquid nebulizer or the use of a dry powder apparatus such as that described in U.S. Pat. No. 5,780,014, incorporated herein by reference.

In certain embodiments, the compositions of the disclosure may be formulated such that they may be aerosolized or otherwise delivered as a particulate liquid or solid prior to or upon administration to the subject. Such compositions may be administered with the assistance of one or more suitable devices for administering such solid or liquid particulate compositions (such as, e.g., an aerosolized aqueous solution or suspension) to generate particles that are easily respirable or inhalable by the subject. In some embodiments, such devices (e.g., a metered dose inhaler, jet-nebulizer, ultrasonic nebulizer, dry-powder-inhalers, propellant-based inhaler or an insufflator) facilitate the administration of a predetermined mass, volume or dose of the compositions (e.g., about 0.5 mg/kg of mRNA per dose) to the subject. For example, in certain embodiments, the compositions of the disclosure are administered to a subject using a metered dose inhaler containing a suspension or solution comprising the composition and a suitable propellant. In certain embodiments, the compositions of the disclosure may be formulated as a particulate powder (e.g., respirable dry particles) intended for inhalation. In certain embodiments, compositions of the disclosure formulated as respirable particles are appropriately sized such that they may be respirable by the subject or delivered using a suitable device (e.g., a mean D50 or D90 particle size less than about 500 μm, 400 μm, 300 μm, 250 μm, 200 μm, 150 μm, 100 μm, 75 μm, 50 μm, 25 μm, 20 μm, 15 μm, 12.5 μm, 10 μm, 5 μm, 2.5 μm or smaller). In yet other embodiments, the compositions of the disclosure are formulated to include one or more pulmonary surfactants (e.g., lamellar bodies). In some embodiments, the compositions of the disclosure are administered to a subject such that a concentration of at least 0.05 mg/kg, at least 0.1 mg/kg, at least 0.5 mg/kg, at least 1.0 mg/kg, at least 2.0 mg/kg, at least 3.0 mg/kg, at least 4.0 mg/kg, at least 5.0 mg/kg, at least 6.0 mg/kg, at least 7.0 mg/kg, at least 8.0 mg/kg, at least 9.0 mg/kg, at least 10 mg/kg, at least 15 mg/kg, at least 20 mg/kg, at least 25 mg/kg, at least 30 mg/kg, at least 35 mg/kg, at least 40 mg/kg, at least 45 mg/kg, at least 50 mg/kg, at least 55 mg/kg, at least 60 mg/kg, at least 65 mg/kg, at least 70 mg/kg, at least 75 mg/kg, at least 80 mg/kg, at least 85 mg/kg, at least 90 mg/kg, at least 95 mg/kg, or at least 100 mg/kg body weight is administered in a single dose. In some embodiments, the compositions of the disclosure are administered to a subject such that a total amount of at least 0.1 mg, at least 0.5 mg, at least 1.0 mg, at least 2.0 mg, at least 3.0 mg, at least 4.0 mg, at least 5.0 mg, at least 6.0 mg, at least 7.0 mg, at least 8.0 mg, at least 9.0 mg, at least 10 mg, at least 15 mg, at least 20 mg, at least 25 mg, at least 30 mg, at least 35 mg, at least 40 mg, at least 45 mg, at least 50 mg, at least 55 mg, at least 60 mg, at least 65 mg, at least 70 mg, at least 75 mg, at least 80 mg, at least 85 mg, at least 90 mg, at least 95 mg or at least 100 mg mRNA is administered in one or more doses.

In some embodiments, a pharmaceutical composition of the present disclosure is administered to a subject once per month. In some embodiments, a pharmaceutical composition of the present disclosure is administered to a subject twice per month. In some embodiments, a pharmaceutical composition of the present disclosure is administered to a subject three times per month. In some embodiments, a pharmaceutical composition of the present disclosure is administered to a subject four times per month.

According to the present disclosure, a therapeutically effective dose of the provided composition, when administered regularly, results in an increased CFTR protein expression or activity level in a subject as compared to a baseline CFTR protein expression or activity level before treatment. Typically, the CFTR protein expression or activity level is measured in a biological sample obtained from the subject such as blood, plasma or serum, urine, or solid tissue extracts. The baseline level can be measured immediately before treatment. In some embodiments, administering a pharmaceutical composition described herein results in an increased CFTR protein expression or activity level in a biological sample (e.g., plasma/serum or lung epithelial swab) by at least about 10%, 20%, 30%, 40%, 50%, 60%, 70%, 80%, 90%, or 95% as compared to a baseline level before treatment. In some embodiments, administering the provided composition results in an increased CFTR protein expression or activity level in a biological sample (e.g., plasma/serum or lung epithelial swab) by at least about 10%, 20%, 30%, 40%, 50%, 60%, 70%, 80%, 90%, or 95% as compared to a baseline level before treatment for at least about 24 hours, at least about 48 hours, at least about 72 hours, at least about 4 days, at least about 5 days, at least about 6 days, at least about 7 days, at least about 8 days, at least about 9 days, at least about 10 days, at least about 11 days, at least about 12 days, at least about 13 days, at least about 14 days, or at least about 15 days.

Treatment of Cystic Fibrosis

The compositions of the present disclosure can be used for treating cystic fibrosis. In some embodiments, the present disclosure provides a method of treating cystic fibrosis by administering to a subject in need of treatment an mRNA encoding a CFTR protein as described herein or a pharmaceutical composition containing the mRNA. The mRNA or a pharmaceutical composition containing the mRNA may be administered directly to the lung of the subject. Various administration routes for pulmonary delivery may be used. In some embodiments, an mRNA or a composition containing an mRNA described herein is administered by inhalation, nebulization or aerosolization. In various embodiments, administration of the mRNA results in expression of CFTR in the lung of the subject (e.g., epithelial cells of the lung).

In a particular embodiment, the present disclosure provides a method of treating cystic fibrosis by administering to the lung of a subject in need of treatment an mRNA comprising a coding sequence which encodes SEQ ID NO:93. In certain embodiments, the present disclosure provides a method of treating cystic fibrosis by administering to the lung of a subject in need of treatment an mRNA comprising a coding sequence which encodes an amino acid sequence at least about 70%, 75%, 80%, 85%, 90%, 95%, 96%, 97%, 98%, 99%, or 100% identical to SEQ ID NO: 93. In another particular embodiment, the present disclosure provides a method of treating cystic fibrosis by administering to the lung of a subject in need of treatment an mRNA comprising a coding sequence of SEQ ID NOs: 100-105. In other embodiments, the present disclosure provides a method of treating cystic fibrosis by administering to the lung of a subject in need of treatment an mRNA comprising a coding sequence at least 65%, 70%, 75%, 80%, 85%, 90%, 95%, 96%, 97%, 98%, 99%, or 100% identical to SEQ ID NOs: 100-105.

CFTR Mutation Classes

The pharmaceutical compositions and methods described herein can be used to treat a patient suffering from CF in any of its classes. These classes are described below.

Class 1A (No mRNA): The first class of mutations keeps the mRNA from even being synthesized. When a protein is going to be made in a cell, an enzyme called RNA polymerase binds to a region in the DNA called a promoter. The promoter is usually located right before the section of DNA that codes for a specific protein. If the promoter for CFTR contains a mutation, it can lead to the RNA polymerase not being able to bind to the DNA and therefore not transcribe the gene into mRNA. The end result is no CFTR protein being produced at all. Examples of mutations that lead to no CFTR mRNA include the Dele2,3 (21 kb) and 1717-1G→A. No therapy is currently available to correct this type of mutation. However, there is some research into treatments to inhibit sodium channels or stimulate other chloride protein channels at the cell surface to balance ion levels without the need for the CFTR protein.

Class 1B (No Protein): In this class of mutations, the CFTR mRNA is produced but is damaged and cannot be made into protein. There is a specific sequence in the DNA that is then carried over to the RNA, which signals to the ribosome to stop reading the message and marks the end of protein production. Sometimes, because of a mutation, one of these stop sequences appears too early in the mRNA. This results in the production of a shortened version of the CFTR protein, which is then degraded by the cell. Gly542X and Trp1282X are types of class 1B mutations. Read-through compounds can help the ribosome skip over the early stop sequence, read the rest of the information on the mRNA, and produce CFTR proteins. Ataluren was one such compound being investigated as a potential treatment for this kind of mutation but its development ended due to failed Phase 3 clinical trial results.

Class 2 (No Traffic): In this class of mutations, the CFTR protein is made but fails to reach the cell membrane. The CFTR protein has 1,480 amino acids in it and sometimes even a single error can cause the protein to misfold. The cell will often stop misfolded proteins from going to the cell surface and will destroy them. Examples of class 2 mutations include Phe508del, Asn1303Lys, and Ala561Glu. To correct the misfolded proteins and help them reach the cell membrane, treatments called CFTR correctors can be used. Some examples of CFTR correctors include lumacaftor/ivacaftor (marketed as Orkambi) and tezacaftor/ivacaftor (marketed as Symdeko), both produced by Vertex Pharmaceuticals.

Class 3 (Impaired Gating): Another type of mutation can result in the production of a CFTR protein that makes it to the cell membrane but does not open correctly. This is often referred to as a "gating defect." Gly551Asp, Ser549Arg, and Gly1349Asp are examples of mutations causing gating defects. Treatments called CFTR potentiators, such as Kalydeco, can be used to open the channels and/or keep them open for longer.

Class 4 (Decreased Conductance): The fourth class of mutation results in a CFTR protein that makes it to the cell membrane and reacts to cell signaling to open, but the protein is misshapen and only allows a small amount of chloride ions to pass through. This reduction in chloride ion movement is called decreased conductance. Examples of such mutations include Arg117His, Arg334Trp, and Ala455Glu. CFTR potentiators can also be helpful for these mutations to keep the channels open for longer to allow more chloride ions to flow through.

Class 5 (Less Protein): Sometimes a mutation can lead to CFTR protein being produced but just not in sufficient amounts. This is often caused by a process called alternative splicing in which correct versions of the protein are sometimes made but more often incorrect versions are produced. The incorrect versions never make it to the cell surface, which leads to a reduction in the number of CFTR protein channels at the cell membrane. Class 5 mutations include 3272-26A→G, 3849+10 kg C→T. Possible treatments for this type of mutation include CFTR correctors to correct the misshapen CFTR proteins, CFTR potentiators to try and keep the working CFTR proteins open for longer, CFTR amplifiers to increase the amount of mRNA and therefore more CFTR protein being produced, or antisense oligonucleotides, which can have a number of different uses.

Class 6 (Less Stable Protein): The final type of mutation can result in a working CFTR protein, but the protein configuration is not stable and will degrade too quickly once on the cell surface. Class 6 mutations include c. 120del123 and rPhe580del. Stabilizers are a class of treatment for this type of mutation. They work to inhibit enzymes that break down CFTR. A treatment called cavosonstat was being investigated for this use but failed to meet primary objectives in a Phase 2 clinical trial.

In some embodiments, a CFTR mRNA lipid formulation or a pharmaceutical composition comprising the same is used to treat a patient having a Class 1A mutation. In some embodiments, a CFTR mRNA lipid formulation or a pharmaceutical composition comprising the same is used to treat a patient having a Class 1B mutation. In some embodiments, a CFTR mRNA lipid formulation or a pharmaceutical composition comprising the same is used to treat a patient having a Class 2 mutation. In some embodiments, a CFTR mRNA lipid formulation or a pharmaceutical composition comprising the same is used to treat a patient having a Class 3 mutation. In some embodiments, a CFTR mRNA lipid formulation or a pharmaceutical composition comprising the same is used to treat a patient having a Class 4 mutation. In some embodiments, a CFTR mRNA lipid formulation or a pharmaceutical composition comprising the same is used to treat a patient having a Class 5 mutation. In some embodiments, a CFTR mRNA lipid formulation or a pharmaceutical composition comprising the same is used to treat a patient having a Class 6 mutation.

Combinations

The CFTR mRNA, formulations thereof, or encoded CFTR proteins described herein may be used in combination with one or more other therapeutic, prophylactic, diagnostic, or imaging agents. By "in combination with," it is not intended to imply that the agents must be administered at the same time and/or formulated for delivery together, although these methods of delivery are within the scope of the present disclosure. Compositions can be administered concurrently with, prior to, or subsequent to, one or more other desired therapeutics or medical procedures. In general, each agent will be administered at a dose and/or on a time schedule determined for that agent. Preferably, the methods of treatment of the present disclosure encompass the delivery of pharmaceutical, prophylactic, diagnostic, or imaging compositions in combination with agents that may improve their bioavailability, reduce and/or modify their metabolism, inhibit their excretion, and/or modify their distribution within the body. As a non-limiting example, mRNA disclosed herein and preferably an mRNA sequence comprising SEQ ID NO: 49, 53, 66, 68, 69, 72, or 100-105 encoding a CFTR protein of SEQ ID NO: 99 may be used in combination with a pharmaceutical agent for the treatment of CFTR deficiency. The pharmaceutical agent includes, but is not limited to one or more of: Trikafta® (Elexacaftor, ivacaftor, tezacaftor, marketed by Vertex Pharmaceuticals), Symdeko® (tezacaftor and ivacaftor, Vertex), Orkambi® (lumacaftor and ivacaftor, Vertex), Kalydeco® (ivacaftor, Vertex), compositions and agents for airway clearance, antibiotics, anti-inflammatory agents, bronchodilators, mucus thinners, etc. Multiple vitamins, calcium supplements or combined with a low protein/high caloric diet regimen. In general, it is expected that agents utilized in combination with the presently disclosed CFTR mRNA and formulations thereof be utilized at levels that do not exceed the levels at which they are utilized individually. In some embodiments, the levels utilized in combination will be lower than those utilized individually. In one embodiment, the combinations, each or together may be administered according to the split dosing regimens as are known in the art.

Definitions

At various places in the present specification, substituents of compounds of the present disclosure are disclosed in groups or in ranges. It is specifically intended that the present disclosure include each and every individual subcombination of the members of such groups and ranges. For example, the term "$C_{1-6}$ alkyl" is specifically intended to individually disclose methyl, ethyl, $C_3$ alkyl, $C_4$ alkyl, $C_5$ alkyl, and $C_6$ alkyl.

The phrases "administered in combination" or "combined administration" means that two or more agents are administered to a subject at the same time or within an interval such that there may be an overlap of an effect of each agent on the patient. In some embodiments, they are administered within about 60, 30, 15, 10, 5, or 1 minute of one another. In some embodiments, the administrations of the agents are spaced sufficiently closely together such that a combinatorial (e.g., a synergistic) effect is achieved.

As used herein, the term "animal" refers to any member of the animal kingdom. In some embodiments, "animal" refers to humans at any stage of development. In some embodiments, "animal" refers to non-human animals at any stage of development. In certain embodiments, the non-human animal is a mammal (e.g., a rodent, a mouse, a rat, a rabbit, a monkey, a dog, a cat, a sheep, cattle, a primate, or a pig). In some embodiments, animals include, but are not limited to, mammals, birds, reptiles, amphibians, fish, and worms. In some embodiments, the animal is a transgenic animal, genetically engineered animal, or a clone.

The term "approximately" or "about," as applied to one or more values of interest, refers to a value that is similar to a stated reference value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

The terms "associated with," "conjugated," "linked," "attached," and "tethered," when used with respect to two or more moieties, means that the moieties are physically associated or connected with one another, either directly or via one or more additional moieties that serves as a linking agent, to form a structure that is sufficiently stable so that the moieties remain physically associated under the conditions in which the structure is used, e.g., physiological conditions. An "association" need not be strictly through direct covalent chemical bonding. It may also suggest ionic or hydrogen bonding or a hybridization-based connectivity sufficiently stable such that the "associated" entities remain physically associated.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The disclosure includes embodiments in which exactly one member of the group is present in, employed in, or otherwise relevant to a given product or process. The disclosure includes embodiments in which more than one, or all of the group members are present in, employed in, or otherwise relevant to a given product or process.

The term "acyl," as used herein, represents a hydrogen or an alkyl group (e.g., a haloalkyl group), as defined herein, that is attached to the parent molecular group through a carbonyl group, as defined herein, and is exemplified by formyl (i.e., a carboxyaldehyde group), acetyl, trifluoroacetyl, propionyl, butanoyl and the like. Example unsubstituted acyl groups include from 1 to 7, from 1 to 11, or from 1 to 21 carbons. In some embodiments, the alkyl group is further substituted with 1, 2, 3, or 4 substituents as described herein.

The term "alkenyl," as used herein, represents monovalent straight or branched chain groups of, unless otherwise specified, from 2 to 20 carbons (e.g., from 2 to 6 or from 2 to 10 carbons) containing one or more carbon-carbon double bonds and is exemplified by ethenyl, 1-propenyl, 2-propenyl, 2-methyl-1-propenyl, 1-butenyl, 2-butenyl, and the like. Alkenyls include both cis and trans isomers. Alkenyl groups may be optionally substituted with 1, 2, 3, or 4 substituent groups that are selected, independently, from amino, aryl, cycloalkyl, or heterocyclyl (e.g., heteroaryl), as defined herein, or any of the example alkyl substituent groups described herein.

The term "alkoxy" represents a chemical substituent of formula —OR, where R is a $C_{1-20}$ alkyl group (e.g., $C_{1-6}$ or $C_{1-10}$ alkyl), unless otherwise specified. Example alkoxy groups include methoxy, ethoxy, propoxy (e.g., n-propoxy and isopropoxy), t-butoxy, and the like. In some embodiments, the alkyl group can be further substituted with 1, 2, 3, or 4 substituent groups as defined herein (e.g., hydroxy or alkoxy).

The term "alkoxyalkyl" represents an alkyl group that is substituted with an alkoxy group. Example unsubstituted alkoxyalkyl groups include between 2 to 40 carbons (e.g., from 2 to 12 or from 2 to 20 carbons, such as $C_{1-6}$ alkoxy-$C_{1-6}$ alkyl, $C_{1-10}$ alkoxy-$C_{1-10}$ alkyl, or $C_{1-20}$ alkoxy-$C_{1-20}$ alkyl). In some embodiments, the alkyl and the alkoxy each can be further substituted with 1, 2, 3, or 4 substituent groups as defined herein for the respective group.

The term "alkoxycarbonyl," as used herein, represents an alkoxy, as defined herein, attached to the parent molecular group through a carbonyl atom (e.g., —C(O)—OR, where R is H or an optionally substituted $C_{1-6}$, $C_{1-10}$, or $C_{1-20}$ alkyl group). Example unsubstituted alkoxycarbonyl include from 1 to 21 carbons (e.g., from 1 to 11 or from 1 to 7 carbons). In some embodiments, the alkoxy group is further substituted with 1, 2, 3, or 4 substituents as described herein.

The term "alkoxycarbonylalkyl," as used herein, represents an alkyl group, as defined herein, that is substituted with an alkoxycarbonyl group, as defined herein (e.g., -alkyl-C(O)—OR, where R is an optionally substituted $C_{1-20}$, $C_{1-10}$, or $C_{1-6}$ alkyl group). Example unsubstituted alkoxycarbonylalkyl include from 3 to 41 carbons (e.g., from 3 to 10, from 3 to 13, from 3 to 17, from 3 to 21, or from 3 to 31 carbons, such as $C_{1-6}$ alkoxycarbonyl-$C_{1-6}$ alkyl, $C_{1-10}$ alkoxycarbonyl-$C_{1-10}$ alkyl, or $C_{1-20}$ alkoxycarbonyl-$C_{1-20}$ alkyl). In some embodiments, each alkyl and alkoxy group is further independently substituted with 1, 2, 3, or 4 substituents as described herein (e.g., a hydroxy group).

The term "alkoxycarbonylalkenyl," as used herein, represents an alkenyl group, as defined herein, that is substituted with an alkoxycarbonyl group, as defined herein (e.g., -alkenyl-C(O)—OR, where R is an optionally substituted $C_{1-20}$, $C_{1-10}$, or $C_{1-6}$ alkyl group). Example unsubstituted alkoxycarbonylalkenyl include from 4 to 41 carbons (e.g., from 4 to 10, from 4 to 13, from 4 to 17, from 4 to 21, or from 4 to 31 carbons, such as $C_{1-6}$ alkoxycarbonyl-$C_{2-6}$ alkenyl, $C_{1-10}$ alkoxycarbonyl-$C_{2-10}$ alkenyl, or $C_{1-20}$ alkoxycarbonyl-$C_2$-20 alkenyl). In some embodiments, each alkyl, alkenyl, and alkoxy group is further independently substituted with 1, 2, 3, or 4 substituents as described herein (e.g., a hydroxy group).

As used herein, "alkyl" refers to a straight or branched hydrocarbon chain that is fully saturated (i.e., contains no double or triple bonds). The alkyl group may have 1 to 20 carbon atoms (whenever it appears herein, a numerical range such as "1 to 20" refers to each integer in the given range; e.g., "1 to 20 carbon atoms" means that the alkyl group may consist of 1 carbon atom, 2 carbon atoms, 3 carbon atoms, etc., up to and including 20 carbon atoms, although the present definition also covers the occurrence of the term "alkyl" where no numerical range is designated). The alkyl group may also be a medium size alkyl having 1 to 9 carbon atoms. The alkyl group could also be a lower alkyl having 1 to 6 carbon atoms. The alkyl group may be designated as "$C_{1-4}$ alkyl" or similar designations. By way of example only, "$C_{1-4}$ alkyl" indicates that there are one to four carbon atoms in the alkyl chain, i.e., the alkyl chain is selected from the group consisting of methyl, ethyl, propyl, isopropyl, n-butyl, iso-butyl, sec-butyl, and t-butyl. Typical alkyl groups include, but are in no way limited to, methyl, ethyl, propyl, isopropyl, butyl, isobutyl, tertiary butyl, pentyl, hexyl, and the like.

The term "lower alkyl" means a group having one to six carbons in the chain which chain may be straight or branched. Non-limiting examples of suitable alkyl groups include methyl, ethyl, n-propyl, isopropyl, n-butyl, t-butyl, n-pentyl, and hexyl.

The term "alkylsulfinyl," as used herein, represents an alkyl group attached to the parent molecular group through an —S(O)— group. Example unsubstituted alkylsulfinyl groups are from 1 to 6, from 1 to 10, or from 1 to 20 carbons. In some embodiments, the alkyl group can be further substituted with 1, 2, 3, or 4 substituent groups as defined herein.

The term "alkylsulfinylalkyl," as used herein, represents an alkyl group, as defined herein, substituted by an alkylsulfinyl group. Example unsubstituted alkylsulfinylalkyl groups are from 2 to 12, from 2 to 20, or from 2 to 40 carbons. In some embodiments, each alkyl group can be further substituted with 1, 2, 3, or 4 substituent groups as defined herein.

The term "alkynyl," as used herein, represents monovalent straight or branched chain groups from 2 to 20 carbon atoms (e.g., from 2 to 4, from 2 to 6, or from 2 to 10 carbons) containing a carbon-carbon triple bond and is exemplified by ethynyl, 1-propynyl, and the like. Alkynyl groups may be optionally substituted with 1, 2, 3, or 4 substituent groups that are selected, independently, from aryl, cycloalkyl, or heterocyclyl (e.g., heteroaryl), as defined herein, or any of the example alkyl substituent groups described herein.

The term "amidine," as used herein, represents a —C(=NH)$NH_2$ group.

The term "amino," as used herein, represents —N($R^{N1}$)$_2$, wherein each $R^{N1}$ is, independently, H, OH, $NO_2$, N($R^{N2}$)$_2$, $SO_2OR^{N2}$, $SO_2RN^2$, $SOR^{N2}$, an N-protecting group, alkyl, alkenyl, alkynyl, alkoxy, aryl, alkaryl, cycloalkyl, alkylcycloalkyl, carboxyalkyl (e.g., optionally substituted with an O-protecting group, such as optionally substituted arylalkoxycarbonyl groups or any described herein), sulfoalkyl, acyl (e.g., acetyl, trifluoroacetyl, or others described herein), alkoxycarbonylalkyl (e.g., optionally substituted with an O-protecting group, such as optionally substituted arylalkoxycarbonyl groups or any described herein), heterocyclyl (e.g., heteroaryl), or alkylheterocyclyl (e.g., alkylheteroaryl), wherein each of these recited $R^{N1}$ groups can be optionally substituted, as defined herein for each group; or two $R^{N1}$ combine to form a heterocyclyl or an N-protecting group, and wherein each $R^{N2}$ is, independently, H, alkyl, or aryl. The amino groups of the disclosure can be an unsubstituted amino (i.e., —$NH_2$) or a substituted amino (i.e., —N(R')$_2$). In a preferred embodiment, amino is —$NH_2$ or —$NHR^{N1}$, wherein $R^{N1}$ is, independently, OH, $NO_2$, $NH_2$, $NR^{N2}{}_2$, $SO_2OR^{N2}$, $SO_2RN^2$, $SOR^{N2}$, alkyl, carboxyalkyl, sulfoalkyl, acyl (e.g., acetyl, trifluoroacetyl, or others described herein), alkoxycarbonylalkyl (e.g., t-butoxycarbonylalkyl) or aryl, and each $R^{N2}$ can be H, $C_{1-20}$ alkyl (e.g., $C_{1-6}$ alkyl), or $C_{1-10}$ aryl.

The term "amino acid," as described herein, refers to a molecule having a side chain, an amino group, and an acid group (e.g., a carboxy group of —$CO_2H$ or a sulfo group of —$SO_3H$), wherein the amino acid is attached to the parent molecular group by the side chain, amino group, or acid group (e.g., the side chain). In some embodiments, the amino acid is attached to the parent molecular group by a carbonyl group, where the side chain or amino group is attached to the carbonyl group. Example side chains include an optionally substituted alkyl, aryl, heterocyclyl, alkylaryl, alkylheterocyclyl, aminoalkyl, carbamoylalkyl, and carboxyalkyl. Example amino acids include alanine, arginine, asparagine, aspartic acid, cysteine, glutamic acid, glutamine, glycine, histidine, hydroxynorvaline, isoleucine, leucine, lysine, methionine, norvaline, omithine, phenylalanine, proline, pyrrolysine, selenocysteine, serine, taurine, threonine, tryptophan, tyrosine, and valine. Amino acid groups may be optionally substituted with one, two, three, or, in the case of amino acid groups of two carbons or more, four substituents independently selected from the group consisting of: (1) $C_{1-6}$ alkoxy; (2) $C_{1-6}$ alkylsulfinyl; (3) amino, as defined herein (e.g., unsubstituted amino (i.e., —$NH_2$) or a substituted amino (i.e., —N($R^{N1}$)$_2$, where $R^{N1}$ is as defined for amino); (4) $C_{6-10}$ aryl-$C_{1-6}$ alkoxy; (5) azido; (6) halo; (7) ($C_{2-9}$ heterocyclyl)oxy; (8) hydroxy; (9) nitro; (10) oxo (e.g., carboxyaldehyde or acyl); (11) $C_{1-7}$ spirocyclyl; (12) thioalkoxy; (13) thiol; (14) —$CO_2R^{A'}$, where $R^{A'}$ is selected from the group consisting of (a) $C_{1-20}$ alkyl (e.g., $C_{1-6}$ alkyl), (b) $C_{2-20}$ alkenyl (e.g., $C_{2-6}$ alkenyl), (c) $C_{6-10}$ aryl, (d) hydrogen, (e) $C_{1-6}$ alkyl-$C_{6-10}$ aryl, (f) amino-$C_{1-20}$ alkyl, (g) polyethylene glycol of —$(CH_2)_{s2}(OCH_2CH_2)_{s1}(CH_2)_{s3}OR'$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h) amino-polyethylene glycol of —$NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; (15) —$C(O)NR^{B'}R^{C'}$, where each of $R^{B'}$ and $R^{C'}$ is, independently, selected from the group consisting of (a) hydrogen, (b) $C_{1-6}$ alkyl, (c) $C_{6-10}$ aryl, and (d) $C_{1-6}$ alkyl-$C_{6-10}$ aryl; (16) —$SO_2R^{D'}$, where $R^{D'}$ is selected from the group consisting of (a) $C_{1-6}$ alkyl, (b) $C_{6-10}$ aryl, (c) $C_{1-6}$ alkyl-$C_{6-10}$ aryl, and (d) hydroxy; (17) —$SO_2NR^{E'}R^{F'}$, where each of $R^{E'}$ and $R^{F'}$ is, independently, selected from the group consisting of (a) hydrogen, (b) $C_{1-6}$ alkyl, (c) $C_{6-10}$ aryl and (d) $C_{1-6}$ alkyl-$C_{6-10}$ aryl; (18) —$C(O)R^{G'}$, where $R^{G'}$ is selected from the group consisting of (a) $C_{1-20}$ alkyl (e.g., $C_{1-6}$ alkyl), (b) $C_{2-20}$ alkenyl (e.g., $C_{2-6}$ alkenyl), (c) $C_{6-10}$ aryl, (d) hydrogen, (e) $C_{1-6}$ alkyl-$C_{6-10}$ aryl, (f) amino-$C_{1-20}$ alkyl, (g) polyethylene glycol of —$(CH_2)_{s2}(OCH_2CH_2)_{s1}(CH_2)_{s3}OR'$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h) amino-polyethylene glycol of —$NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; (19) —$NR^{H'}C(O)R^{I'}$, wherein $R^{H'}$ is selected from the group consisting of (a1) hydrogen and (b1) $C_{1-6}$ alkyl, and $R^{I'}$ is selected from the group consisting of (a2) $C_{1-20}$ alkyl (e.g., $C_{1-6}$ alkyl), (b2) $C_{2-20}$ alkenyl (e.g., $C_{2-6}$ alkenyl), (c2) $C_{6-10}$ aryl, (d2) hydrogen, (e2) $C_{1-6}$ alkyl-$C_{6-10}$ aryl, (f2) amino-$C_{1-20}$ alkyl, (g2) polyethylene glycol of —$(CH_2)_{s2}(OCH_2CH_2)_{s1}(CH_2)_{s3}OR'$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h2) amino-polyethylene glycol of —$NR^{N1}(CH_2)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; (20) —$NR^{J'}C(O)OR^{K'}$, wherein $R^{J'}$ is selected from the group consisting of (a1) hydrogen and (b1) $C_{1-6}$ alkyl, and $R^{K'}$ is selected from the group consisting of (a2) $C_{1-20}$ alkyl (e.g., $C_{1-6}$ alkyl), (b2) $C_{2-20}$ alkenyl (e.g., $C_{2-6}$ alkenyl), (c2) $C_{6-10}$ aryl, (d2) hydrogen, (e2) $C_{1-6}$ alkyl-$C_{6-10}$ aryl, (f2) amino-$C_{1-20}$ alkyl, (g2) polyethylene glycol of —$(CH_2)_{s2}(OCH_2CH_2)_{s1}(CH_2)_{s3}OR'$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and R' is H or $C_{1-20}$ alkyl, and (h2) amino-polyethylene glycol of —$NR^{N1}(CH)_{s2}(CH_2CH_2O)_{s1}(CH_2)_{s3}NR^{N1}$, wherein s1 is an integer from 1 to 10 (e.g., from 1 to 6 or from 1 to 4), each of s2 and s3, independently, is an integer from 0 to 10 (e.g., from 0 to 4, from 0 to 6, from 1 to 4, from 1 to 6, or from 1 to 10), and each $R^{N1}$ is, independently, hydrogen or optionally substituted $C_{1-6}$ alkyl; and (21) amidine. In some embodiments, each of these groups can be further substituted as described herein.

The term "aminoalkyl," as used herein, represents an alkyl group, as defined herein, substituted by an amino group, as defined herein. The alkyl and amino each can be further substituted with 1, 2, 3, or 4 substituent groups as described herein for the respective group (e.g., $CO_2R^{A'}$, where $R^{A'}$ is selected from the group consisting of (a) $C_{1-6}$ alkyl, (b) $C_{6-10}$ aryl, (c) hydrogen, and (d) $C_{1-6}$ alkyl-$C_{6-10}$ aryl, e.g., carboxy, and/or an N-protecting group).

The term "aminoalkenyl," as used herein, represents an alkenyl group, as defined herein, substituted by an amino group, as defined herein. The alkenyl and amino each can be further substituted with 1, 2, 3, or 4 substituent groups as described herein for the respective group (e.g., $CO_2R^{A'}$, where $R^{A'}$ is selected from the group consisting of (a) $C_{1-6}$ alkyl, (b) $C_{6-10}$ aryl, (c) hydrogen, and (d) $C_{1-6}$ alkyl-$C_{6-10}$ aryl, e.g., carboxy, and/or an N-protecting group).

The term "anionic lipid" means a lipid that is negatively charged at physiological pH. These lipids include, but are not limited to, phosphatidylglycerols, cardiolipins, diacylphosphatidylserines, diacylphosphatidic acids, N-dodecanoyl phosphatidylethanolamines, N-succinyl phosphatidylethanolamines, N-glutarylphosphatidylethanolamines, lysylphosphatidylglycerols, palmitoylolеyolphosphatidylglycerol (POPG), and other anionic modifying groups joined to neutral lipids.

The phrase "at least one of" preceding a series of items, with the term "and" or "or" to separate any of the items, modifies the list as a whole, rather than each member of the list (i.e., each item). The phrase "at least one of" does not require selection of at least one of each item listed; rather, the phrase allows a meaning that includes at least one of any one of the items, and/or at least one of any combination of the items, and/or at least one of each of the items. By way of example, the phrases "at least one of A, B, and C" or "at least one of A, B, or C" each refer to only A, only B, or only C; any combination of A, B, and C; and/or at least one of each of A, B, and C.

The terms "include," "have," or the like is used in the description or the claims, such term is intended to be inclusive in a manner similar to the term "comprise" as "comprise" is interpreted when employed as a transitional word in a claim.

A reference to an element in the singular is not intended to mean "one and only one" unless specifically stated, but rather "one or more." Pronouns in the masculine (e.g., his) include the feminine and neuter gender (e.g., her and its) and vice versa. The term "some" refers to one or more. Underlined and/or italicized headings and subheadings are used for convenience only, do not limit the subject technology, and are not referred to in connection with the interpretation of the description of the subject technology. All structural and functional equivalents to the elements of the various configurations described throughout this disclosure that are known or later come to be known to those of ordinary skill in the art are expressly incorporated herein by reference and intended to be encompassed by the subject technology. Moreover, nothing disclosed herein is intended to be dedicated to the public regardless of whether such disclosure is explicitly recited in the above description.

The term "boranyl," as used herein, represents —$B(R^{B1})_3$, where each $R^{B1}$ is, independently, selected from the group consisting of H and optionally substituted alkyl. In some embodiments, the boranyl group can be substituted with 1, 2, 3, or 4 substituents as defined herein for alkyl.

The term "boranophosphate" has the ordinary meaning as understood in the art and can include protonated, deprotonated, and tautomeric forms thereof. For example, a boranophosphate within the context of a compound can have the structure

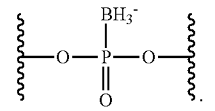

The term "biocompatible" means compatible with living cells, tissues, organs or systems posing little to no risk of injury, toxicity or rejection by the immune system.

The term "biodegradable" means capable of being broken down into innocuous products by the action of living things.

The phrase "biologically active" refers to a characteristic of any substance that has activity in a biological system and/or organism. For instance, a substance that, when administered to an organism, has a biological effect on that organism, is considered to be biologically active. In particular embodiments, a polynucleotide of the present disclosure may be considered biologically active if even a portion of the polynucleotide is biologically active or mimics an activity considered biologically relevant.

The terms "carbocyclic" and "carbocyclyl," as used herein, refer to an optionally substituted $C_{3-12}$ monocyclic, bicyclic, or tricyclic structure in which the rings, which may be aromatic or non-aromatic, are formed by carbon atoms. Carbocyclic structures include cycloalkyl, cycloalkenyl, and aryl groups.

The term "carbamoyl," as used herein, represents —C(O)—N($R^{N1}$)$_2$, where the meaning of each $R^{N1}$ is found in the definition of "amino" provided herein.

The term "carbamoylalkyl," as used herein, represents an alkyl group, as defined herein, substituted by a carbamoyl group, as defined herein. The alkyl group can be further substituted with 1, 2, 3, or 4 substituent groups as described herein.

The term "carbamyl," as used herein, refers to a carbamate group having the structure —NR$^{N1}$C(═O)OR or —OC(═O)N($R^{N1}$)$_2$, where the meaning of each $R^{N1}$ is found in the definition of "amino" provided herein, and R is alkyl, cycloalkyl, alkylcycloalkyl, aryl, alkylaryl, heterocyclyl (e.g., heteroaryl), or alkylheterocyclyl (e.g., alkylheteroaryl), as defined herein.

The term "carbonyl," as used herein, represents a C(O) group, which can also be represented as C═O.

The term "carboxyaldehyde" represents an acyl group having the structure —C(O)H.

The term "carboxy," as used herein, means —$CO_2H$.

The term "cationic lipid" means amphiphilic lipids and salts thereof having a positive, hydrophilic head group; one, two, three, or more hydrophobic fatty acid or fatty alkyl chains; and a connector between these two domains. An ionizable or protonatable cationic lipid is typically protonated (i.e., positively charged) at a pH below its $pK_a$ and is substantially neutral at a pH above the $pK_a$. Preferred ionizable cationic lipids are those having a pKa that is less than physiological pH, which is typically about 7.4. The cationic lipids of the disclosure may also be termed titratable cationic lipids. The cationic lipids can be an "amino lipid" having a protonatable tertiary amine (e.g., pH-titratable) head group. Some amino exemplary amino lipid can include $C_{18}$ alkyl chains, wherein each alkyl chain independently has 0 to 3 (e.g., 0, 1, 2, or 3) double bonds; and ether, ester, or ketal linkages between the head group and alkyl chains. Such cationic lipids include, but are not limited to, DSDMA, DODMA, DLinDMA, DLenDMA, γ-DLenDMA, DLin-K-DMA, DLin-K-C2-DMA (also known as DLin-C2K-DMA, XTC2, and C2K), DLin-K-C3-DM A, DLin-K-C4-DMA, DLen-C2K-DMA, y-DLen-C2K-DMA, DLin-M-C2-DMA (also known as MC2), DLin-M-$C_3$-DMA (also known as MC3) and (DLin-MP-DMA)(also known as 1-Bl 1).

The term "comprising" is intended to be open and permits but does not require the inclusion of additional elements or steps. When the term "comprising" is used herein, the term "consisting of" is thus also encompassed and disclosed.

The term "composition" means a product comprising the specified ingredients in the specified amounts, as well as any product that results, directly or indirectly, from combination of the specified ingredients in the specified amounts.

The term "in combination with" means the administration of a lipid formulated mRNA of the present disclosure with other medicaments in the methods of treatment of this disclosure, means—that the lipid formulated mRNA of the present disclosure and the other medicaments are administered sequentially or concurrently in separate dosage forms, or are administered concurrently in the same dosage form.

The term "commercially available chemicals" and the chemicals used in the Examples set forth herein may be obtained from standard commercial sources, where such sources include, for example, Acros Organics (Pittsburgh, Pa.), Sigma-Adrich Chemical (Milwaukee, Wis.), Avocado Research (Lancashire, U.K.), Bionet (Cornwall, U.K.), Boron Molecular (Research Triangle Park, N.C.), Combi-Blocks (San Diego, Calif.), Eastman Organic Chemicals, Eastman Kodak Company (Rochester, N.Y.), Fisher Scientific Co. (Pittsburgh, Pa.), Frontier Scientific (Logan, Utah), ICN Biomedicals, Inc. (Costa Mesa, Calif.), Lancaster Synthesis (Windham, N.H.), Maybridge Chemical Co. (Cornwall, U.K.), Pierce Chemical Co. (Rockford, Ill.), Riedel de Haen (Hannover, Germany), Spectrum Quality Product, Inc. (New Brunswick, N.J.), TCI America (Portland, Oreg.), and Wako Chemicals USA, Inc. (Richmond, Va.).

The phrase "compounds described in the chemical literature" may be identified through reference books and databases directed to chemical compounds and chemical reactions, as known to one of ordinary skill in the art. Suitable reference books and treatise that detail the synthesis of reactants useful in the preparation of compounds disclosed herein, or provide references to articles that describe the preparation of compounds disclosed herein, include for example, "Synthetic Organic Chemistry," John Wiley and Sons, Inc. New York; S. R. Sandler et al, "Organic Functional Group Preparations," 2nd Ed., Academic Press, New York, 1983; H. O. House, "Modem Synthetic Reactions," 2nd Ed., W. A. Benjamin, Inc. Menlo Park, Calif., 1972; T. L. Glichrist, "Heterocyclic Chemistry," 2nd Ed. John Wiley and Sons, New York, 1992; J. March, "Advanced Organic Chemistry: reactions, Mechanisms and Structure," 5th Ed., Wiley Interscience, New York, 2001; Specific and analogous reactants may also be identified through the indices of known chemicals prepared by the Chemical Abstract Service of the American Chemical Society, which are available in most public and university libraries, as well as through online databases (the American Chemical Society, Washington, D.C. may be contacted for more details). Chemicals that are known but not commercially available in catalogs may be prepared by custom chemical synthesis houses, where many of the standard chemical supply houses (such as those listed above) provide custom synthesis services.

The term "complementary nucleotide bases" means a pair of nucleotide bases that form hydrogen bonds with each other. Adenine (A) pairs with thymine (T) or with uracil (U) in RNA, and guanine (G) pairs with cytosine (C). Complementary segments or strands of nucleic acid that hybridize (i.e. join by hydrogen bonding) with each other. By "complementary" is meant that a nucleic acid can form hydrogen bond(s) with another nucleic acid sequence either by traditional Watson-Crick or by other non-traditional modes of binding.

The term "cycloalkyl," as used herein represents a monovalent saturated or unsaturated non-aromatic cyclic hydrocarbon group from three to eight carbons, unless otherwise specified, and is exemplified by cyclopropyl, cyclobutyl, cyclopentyl, cyclohexyl, cycloheptyl, bicycle heptyl, and the like. When the cycloalkyl group includes one carbon-carbon double bond, the cycloalkyl group can be referred to as a "cycloalkenyl" group. Exemplary cycloalkenyl groups include cyclopentenyl, cyclohexenyl, and the like. The cycloalkyl groups of this disclosure can be optionally substituted with: (1) $C_{1-7}$ acyl (e.g., carboxyaldehyde); (2) $C_{1-20}$ alkyl (e.g., $C_{1-6}$ alkyl, $C_{1-6}$ alkoxy-$C_{1-6}$ alkyl, $C_{1-6}$ alkylsulfinyl-$C_{1-6}$ alkyl, amino-$C_{1-6}$ alkyl, azido-$C_{1-6}$ alkyl, (carboxyaldehyde)-$C_{1-6}$ alkyl, halo-$C_{1-6}$ alkyl (e.g., perfluoroalkyl), hydroxy-$C_{1-6}$ alkyl, nitro-$C_{1-6}$ alkyl, or $C_{1-6}$ thioalkoxy-$C_{1-6}$ alkyl); (3) $C_{12}$ alkoxy (e.g., $C_{1-6}$ alkoxy, such as perfluoroalkoxy); (4) $C_{1-6}$ alkylsulfinyl; (5) $C_{6-10}$ aryl; (6) amino; (7) $C_{1-6}$ alkyl-$C_{6-10}$ aryl; (8) azido; (9) $C_{3-8}$ cycloalkyl; (10) $C_{1-6}$ alkyl-$C_{3-8}$ cycloalkyl; (11) halo; (12) $C_{1-12}$ heterocyclyl (e.g., $C_{1-12}$ heteroaryl); (13) ($C_{1-12}$ heterocyclyl)oxy; (14) hydroxy; (15) nitro; (16) $C_{1-20}$ thioalkoxy (e.g., $C_{1-6}$ thioalkoxy); (17) —$(CH_2)_qCO_2R^{A'}$, where q is an integer from zero to four, and $R^{A'}$ is selected from the group consisting of (a) $C_{1-6}$ alkyl, (b) $C_{6-10}$ aryl, (c) hydrogen, and (d) $C_{1-6}$ alkyl-$C_{6-10}$ aryl; (18) —$(CH_2)_qCONR^{B'}R^{C'}$, where q is an integer from zero to four and where $R^{B'}$ and $R^{C'}$ are independently selected from the group consisting of (a) hydrogen, (b) $C_{6-10}$ alkyl, (c) $C_{6-10}$ aryl, and (d) $C_{1-6}$ alkyl-$C_{6-10}$ aryl; (19) —$(CH_2)_qSO_2R^{D'}$, where q is an integer from zero to four and where $R^{D'}$ is selected from the group consisting of (a) $C_{6-10}$ alkyl, (b) $C_{6-10}$ aryl, and (c) $C_{1-6}$ alkyl-$C_{6-10}$ aryl; (20) —$(CH_2)_qSO_2NR^{E'}R^{F'}$, where q is an integer from zero to four and where each of $R^{E'}$ and $R^{F'}$ is, independently, selected from the group consisting of (a) hydrogen, (b) $C_{6-10}$ alkyl, (c) $C_{6-10}$ aryl, and (d) $C_{1-6}$ alkyl-$C_{1-10}$ aryl; (21) thiol; (22) $C_{6-10}$ aryloxy; (23) $C_{3-8}$ cycloalkoxy; (24) $C_{6-10}$ aryl-$C_{1-6}$ alkoxy; (25) $C_{1-6}$ alkyl-$C_{1-12}$ heterocyclyl (e.g., $C_{1-6}$ alkyl-$C_{1-12}$ heteroaryl); (26) oxo; (27) $C_{2-20}$ alkenyl; and (28) $C_{2-20}$ alkynyl. In some embodiments, each of these groups can be further substituted as described herein. For example, the alkyl group of a $C_1$-alkaryl or a $C_1$-alkylheterocyclyl can be further substituted with an oxo group to afford the respective aryloyl and (heterocyclyl)oyl substituent group.

The term "diastereomer," as used herein means stereoisomers that are not mirror images of one another and are non-superimposable on one another.

The term "diacylglycerol" or "DAG" includes a compound having 2 fatty acyl chains, $R^1$ and $R^2$, both of which have independently between 2 and 30 carbons bonded to the 1- and 2-position of glycerol by ester linkages. The acyl groups can be saturated or have varying degrees of unsaturation. Suitable acyl groups include, but are not limited to, lauroyl ($C_{12}$), myristoyl ($C_{14}$), palmitoyl ($C_{16}$), stearoyl ($C_{18}$), and icosoyl ($C_{20}$). In preferred embodiments, $R^1$ and $R^2$ are the same, i.e., $R^1$ and $R^2$ are both myristoyl (i.e., dimyristoyl), $R^1$ and $R^2$ are both stearoyl (i.e., distearoyl).

The term "dialkyloxypropyl" or "DAA" includes a compound having 2 alkyl chains, R and R, both of which have independently between 2 and 30 carbons. The alkyl groups can be saturated or have varying degrees of unsaturation.

The term "effective amount" of an agent, as used herein, is that amount sufficient to effect beneficial or desired results, for example, clinical results, and, as such, an "effective amount" depends upon the context in which it is being applied. For example, in the context of administering an agent that treats cancer, an effective amount of an agent is, for example, an amount sufficient to achieve treatment, as defined herein, of cancer, as compared to the response obtained without administration of the agent.

The term "enantiomer," as used herein, means each individual optically active form of a compound of the disclosure, having an optical purity or enantiomeric excess (as determined by methods standard in the art) of at least 80% (i.e., at least 90% of one enantiomer and at most 10% of the other enantiomer), preferably at least 90% and more preferably at least 98%.

An "enzyme having cystic fibrosis transmembrane conductance regulator activity", an "enzyme having CFTR activity", a "protein having CFTR activity", a "protein having cystic fibrosis transmembrane conductance regulator activity", a "CFTR enzyme", or a "CFTR protein" means a protein or enzyme that conducts chloride ions across epithelial cell membranes and helps to maintain the balance of salt and water on the epithelial surfaces of the body. The CFTR protein is a particular type of protein called an ion channel, which has a tubular shape and moves atoms or molecules that have an electrical charge from inside the cell to outside or from outside the cell to inside. In the lung, the CFTR ion channel moves chloride ions from inside the cell to outside the cell. To get out of the cell, the chloride ions move through the center of the tube formed by the CFTR protein. Once the chloride ions are outside the cell, they attract a layer of water. This water layer is important because it allows cilia on the surface of the lung cells, to sweep back and forth. This sweeping motion moves mucus up and out of the airways.

The term "fully encapsulated" means that the nucleic acid (e.g., mRNA) in the nucleic acid-lipid particle is not significantly degraded after exposure to serum or a nuclease assay that would significantly degrade free RNA. When fully encapsulated, preferably less than 25% of the nucleic acid in the particle is degraded in a treatment that would normally degrade 100% of free nucleic acid, more preferably less than 10%, and most preferably less than 5% of the nucleic acid in the particle is degraded. "Fully encapsulated" also means that the nucleic acid-lipid particles do not rapidly decompose into their component parts upon in vivo administration.

The terms "halo" and "Halogen", as used herein, represents a halogen selected from bromine, chlorine, iodine, or fluorine.

The term "haloalkyl," as used herein, represents an alkyl group, as defined herein, substituted by a halogen group (i.e., F, Cl, Br, or I). A haloalkyl may be substituted with one, two, three, or, in the case of alkyl groups of two carbons or more, four halogens. Haloalkyl groups include perfluoroalkyls (e.g., —$CF_3$), —$CHF_2$, —$CH_2F$, —$CCl_3$, —$CH_2CH_2Br$, —$CH_2CH(CH_2CH_2Br)CH_3$, and —$CHICH_3$. In some embodiments, the haloalkyl group can be further substituted with 1, 2, 3, or 4 substituent groups as described herein for alkyl groups.

The term "heteroalkyl," as used herein, refers to an alkyl group, as defined herein, in which one or two of the constituent carbon atoms have each been replaced by nitrogen, oxygen, or sulfur. In some embodiments, the heteroalkyl group can be further substituted with 1, 2, 3, or 4 substituent groups as described herein for alkyl groups.

The term "hydrocarbon," as used herein, represents a group consisting only of carbon and hydrogen atoms.

The term "hydroxy," as used herein, represents an —OH group. In some embodiments, the hydroxy group can be substituted with 1, 2, 3, or 4 substituent groups (e.g., O-protecting groups) as defined herein for an alkyl.

The term "hydroxyalkenyl," as used herein, represents an alkenyl group, as defined herein, substituted by one to three hydroxy groups, with the proviso that no more than one hydroxy group may be attached to a single carbon atom of the alkyl group, and is exemplified by dihydroxypropenyl, hydroxyisopentenyl, and the like. In some embodiments, the hydroxyalkenyl group can be substituted with 1, 2, 3, or 4 substituent groups (e.g., O-protecting groups) as defined herein for an alkyl.

The term "hydroxyalkyl," as used herein, represents an alkyl group, as defined herein, substituted by one to three hydroxy groups, with the proviso that no more than one hydroxy group may be attached to a single carbon atom of the alkyl group, and is exemplified by hydroxymethyl, dihydroxypropyl, and the like. In some embodiments, the hydroxyalkyl group can be substituted with 1, 2, 3, or 4 substituent groups (e.g., O-protecting groups) as defined herein for an alkyl.

The term "hydrate" means a solvate wherein the solvent molecule is $H_2O$.

The term "isomer," as used herein, means any tautomer, stereoisomer, enantiomer, or diastereomer of any compound of the disclosure. It is recognized that the compounds of the disclosure can have one or more chiral centers and/or double bonds and, therefore, exist as stereoisomers, such as double-bond isomers (i.e., geometric E/Z isomers) or diastereomers (e.g., enantiomers (i.e., (+) or (−)) or cis/trans isomers). According to the disclosure, the chemical structures depicted herein, and therefore the compounds of the disclosure, encompass all of the corresponding stereoisomers, that is, both the stereomerically pure form (e.g., geometrically pure, enantiomerically pure, or diastereomerically pure) and enantiomeric and stereoisomeric mixtures, e.g., racemates. Enantiomeric and stereoisomeric mixtures of compounds of the disclosure can typically be resolved into their component enantiomers or stereoisomers by well-known methods, such as chiral-phase gas chromatography, chiral-phase high performance liquid chromatography, crystallizing the compound as a chiral salt complex, or crystallizing the compound in a chiral solvent. Enantiomers and stereoisomers can also be obtained from stereomerically or enantiomerically pure intermediates, reagents, and catalysts by well-known asymmetric synthetic methods.

The term "nitro," as used herein, represents an $—NO_2$ group.

The term "nucleic acid" means deoxyribonucleotides or ribonucleotides and polymers thereof in single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2'-O-methyl ribonucleotides, peptide-nucleic acids (PNAs).

The term "oxo" as used herein, represents =O.

The term "stereoisomer," as used herein, refers to all possible different isomeric as well as conformational forms which a compound may possess (e.g., a compound of any formula described herein), in particular all possible stereochemically and conformationally isomeric forms, all diastereomers, enantiomers and/or conformers of the basic molecular structure. Some compounds of the present disclosure may exist in different tautomeric forms, all of the latter being included within the scope of the present disclosure.

The term "sulfonyl," as used herein, represents an $—S(O)_2—$ group.

The term "compound," is meant to include all stereoisomers, geometric isomers, tautomers, and isotopes of the structures depicted.

The term "conserved" refers to nucleotides or amino acid residues of a polynucleotide sequence or polypeptide sequence, respectively, that are those that occur unaltered in the same position of two or more sequences being compared. Nucleotides or amino acids that are relatively conserved are those that are conserved amongst more related sequences than nucleotides or amino acids appearing elsewhere in the sequences.

The term "cyclic" refers to the presence of a continuous loop. Cyclic molecules need not be circular, only joined to form an unbroken chain of subunits. Cyclic molecules such as the mRNA of the present disclosure may be single units or multimers or comprise one or more components of a complex or higher order structure.

The term "cytotoxic" refers to killing or causing injurious, toxic, or deadly effect on a cell (e.g., a mammalian cell (e.g., a human cell)), bacterium, virus, fungus, protozoan, parasite, prion, or a combination thereof.

The term "delivery" refers to the act or manner of delivering a compound, substance, entity, moiety, cargo or payload.

The term "delivery agent" refers to any substance which facilitates, at least in part, the in vivo delivery of a polynucleotide to targeted cells.

The term "digest" means to break apart into smaller pieces or components. When referring to polypeptides or proteins, digestion results in the production of peptides.

The term "distal" means situated away from the center or away from a point or region of interest.

The phrase "encoded protein cleavage signal" refers to the nucleotide sequence which encodes a protein cleavage signal.

The term "engineered" refers to a molecule designed to have a feature or property, whether structural or chemical, that varies from a starting point, wild type or native molecule.

The term "expression" of a nucleic acid sequence refers to one or more of the following events: (1) production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; and (4) post-translational modification of a polypeptide or protein.

The term "feature" refers to a characteristic, a property, or a distinctive element.

The term "fragment," as used herein, refers to a portion. For example, fragments of proteins may comprise polypeptides obtained by digesting full-length protein isolated from cultured cells.

The term "functional" biological molecule is a biological molecule in a form in which it exhibits a property and/or activity by which it is characterized.

The term "homology" refers to the overall relatedness between polymeric molecules, e.g. between nucleic acid molecules (e.g., DNA molecules and/or RNA molecules) and/or between polypeptide molecules. In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% identical or similar. The term "homologous" necessarily refers to a comparison between at least two sequences (polynucleotide or polypeptide sequences). In accordance with the disclosure, two polynucleotide sequences are considered to be homologous if the polypeptides they encode are at least about 50%, 60%, 70%, 80%, 90%, 95%, or even 99% for at least one stretch of at least about 20 amino acids. In some embodiments, homologous polynucleotide sequences are characterized by the ability to encode a stretch of at least 4-5 uniquely specified amino acids. For polynucleotide sequences less than 60 nucleotides in length, homology is determined by the ability to encode a stretch of at least 4-5 uniquely specified amino acids. In accordance with the disclosure, two protein sequences are considered to be homologous if the proteins are at least about 50%, 60%, 70%, 80%, or 90% identical for at least one stretch of at least about 20 amino acids.

The term "hydrophobic lipids" means compounds having apolar groups that include, but are not limited to, long-chain saturated and unsaturated aliphatic hydrocarbon groups and such groups optionally substituted by one or more aromatic, cycloaliphatic, or heterocyclic group(s). Suitable examples include, but are not limited to, diacylglycerol, dialkylglycerol, N—N-dialkylamino, 1,2-diacyloxy-3-aminopropane, and 1,2-dialkyl-3-aminopropane.

The term "identity" refers to the overall relatedness between polymeric molecules, e.g., between oligonucleotide molecules (e.g. DNA molecules and/or RNA molecules) and/or between polypeptide molecules. Calculation of the percent identity of two polynucleotide sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleotide sequences can be determined using methods such as those described in Computational Molecular Biology, Lesk, A. M., ed., Oxford University Press, New York, 1988; Biocomputing: Informatics and Genome Projects, Smith, D. W., ed., Academic Press, New York, 1993; Sequence Analysis in Molecular Biology, von Heinje, G., Academic Press, 1987; Computer Analysis of Sequence Data, Part I, Griffin, A. M., and Griffin, H. G., eds., Humana Press, New Jersey, 1994; and Sequence Analysis Primer, Gribskov, M. and Devereux, J., eds., M Stockton Press, New York, 1991; each of which is incorporated herein by reference. For example, the percent identity between two nucleotide sequences can be determined using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleotide sequences can, alternatively, be determined using the GAP program in the GCG software package using an NWSgapdna.CMP matrix. Methods commonly employed to determine percent identity between sequences include, but are not limited to those disclosed in Carillo, H., and Lipman, D., SIAM J Applied Math., 48:1073 (1988); incorporated herein by reference. Techniques for determining identity are codified in publicly available computer programs. Exemplary computer software to determine homology between two sequences include, but are not limited to, GCG program package, Devereux, J., et al., *Nucleic Acids Research,* 12(1), 387 (1984)), BLASTP, BLASTN, and FASTA Altschul, S. F. et al., *J. Molec. Biol.,* 215, 403 (1990)).

The term "isolated" refers to a substance or entity that has been separated from at least some of the components with which it was previously associated (whether in nature or in an experimental setting). Isolated substances may have varying levels of purity in reference to the substances from which they have been associated. Isolated substances and/or entities may be separated from at least about 10%, about 20%, about 30%, about 40%, about 50%, about 60%, about 70%, about 80%, about 90%, or more of the other components with which they were initially associated. In some embodiments, isolated agents are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components. Substantially isolated: By "substantially isolated" is meant that the compound is substantially separated from the environment in which it was formed or detected. Partial separation can include, for example, a composition enriched in the compound of the present disclosure. Substantial separation can include compositions containing at least about 50%, at least about 60%, at least about 70%, at least about 80%, at least about 90%, at least about 95%, at least about 97%, or at least about 99% by weight of the compound of the present disclosure, or salt thereof. Methods for isolating compounds and their salts are routine in the art.

The term "lipid" means an organic compound that comprises an ester of fatty acid and is characterized by being insoluble in water, but soluble in many organic solvents. Lipids are usually divided into at least three classes: (1) "simple lipids," which include fats and oils as well as waxes; (2) "compound lipids," which include phospholipids and glycolipids; and (3) "derived lipids" such as steroids.

The term "lipid delivery vehicle" means a lipid formulation that can be used to deliver a therapeutic nucleic acid (e.g., mRNA) to a target site of interest (e.g., cell, tissue, organ, and the like). The lipid delivery vehicle can be a nucleic acid-lipid particle, which can be formed from a cationic lipid, a non-cationic lipid (e.g., a phospholipid), a conjugated lipid that prevents aggregation of the particle (e.g., a PEG-lipid), and optionally cholesterol. Typically, the therapeutic nucleic acid (e.g., mRNA) may be encapsulated in the lipid portion of the particle, thereby protecting it from enzymatic degradation.

The term "lipid encapsulated" means a lipid particle that provides a therapeutic nucleic acid such as an mRNA with full encapsulation, partial encapsulation, or both. In a preferred embodiment, the nucleic acid (e.g., mRNA) is fully encapsulated in the lipid particle.

The term "lipid conjugate" means a conjugated lipid that inhibits aggregation of lipid particles. Such lipid conjugates include, but are not limited to, PEG-lipid conjugates such as, e.g., PEG coupled to dialkyloxypropyls (e.g., PEG-DAA conjugates), PEG coupled to diacylglycerols (e.g., PEG-DAG conjugates), PEG coupled to cholesterol, PEG coupled to phosphatidylethanolamines, and PEG conjugated to ceramides, cationic PEG lipids, polyoxazoline (POZ)-lipid conjugates, polyamide oligomers, and mixtures thereof. PEG or POZ can be conjugated directly to the lipid or may be linked to the lipid via a linker moiety. Any linker moiety suitable for coupling the PEG or the POZ to a lipid can be used including, e.g., non-ester-containing linker moieties and ester-containing linker moieties. In certain preferred embodiments, non-ester-containing linker moieties, such as amides or carbamates, are used.

The term "amphipathic lipid" or "amphiphilic lipid" means the material in which the hydrophobic portion of the lipid material orients into a hydrophobic phase, while the hydrophilic portion orients toward the aqueous phase. Hydrophilic characteristics derive from the presence of polar or charged groups such as carbohydrates, phosphate, carboxylic, sulfato, amino, sulfhydryl, nitro, hydroxyl, and other like groups. Hydrophobicity can be conferred by the inclusion of apolar groups that include, but are not limited to, long-chain saturated and unsaturated aliphatic hydrocarbon groups and such groups substituted by one or more aromatic, cycloaliphatic, or heterocyclic group(s). Examples of amphipathic compounds include, but are not limited to, phospholipids, aminolipids, and sphingolipids.

The term "linker" refers to a group of atoms, e.g., 10-1,000 atoms, and can be comprised of the atoms or groups such as, but not limited to, carbon, amino, alkylamino, oxygen, sulfur, sulfoxide, sulfonyl, carbonyl, and imine. The linker can be attached to a modified nucleoside or nucleotide on the nucleobase or sugar moiety at a first end of the linker, and to a payload, e.g., a detectable or therapeutic agent, at a second end of the linker. The linker may be of sufficient length as to not interfere with incorporation into a nucleic acid sequence. The linker can be used for any useful purpose, such as to form multimers (e.g., through linkage of two or more polynucleotides) or conjugates, as well as to administer a payload, as described herein. Examples of chemical groups that can be incorporated into the linker include, but are not limited to, alkyl, alkenyl, alkynyl, amido, amino, ether, thioether, ester, alkyl, heteroalkyl, aryl, or heterocyclyl, each of which can be optionally substituted, as described herein. Examples of linkers include, but are not limited to, unsaturated alkanes, polyethylene glycols (e.g., ethylene or propylene glycol monomeric units, e.g., diethylene glycol, dipropylene glycol, triethylene glycol, tripropylene glycol, tetraethylene glycol, or tetraethylene glycol), and dextran polymers, Other examples include, but are not limited to, cleavable moieties within the linker, such as, for example, a disulfide bond (—S—S—) or an azo bond (—N═N—), which can be cleaved using a reducing agent or photolysis. Non-limiting examples of a selectively cleavable bond include an amido bond, which can be cleaved for example by the use of tris(2-carboxyethyl)phosphine (TCEP), or other reducing agents, and/or photolysis, as well as an ester bond, which can be cleaved for example by acidic or basic hydrolysis.

The term "mammal" means a human or other mammal or means a human being.

The term "messenger RNA" (mRNA) refers to any polynucleotide which encodes a protein or polypeptide of interest and which is capable of being translated to produce the encoded protein or polypeptide of interest in vitro, in vivo, in situ or ex vivo.

The term "modified" refers to a changed state or structure of a molecule of the disclosure. Molecules may be modified in many ways including chemically, structurally, and functionally. In one embodiment, the mRNA molecules of the present disclosure are modified by the introduction of non-natural nucleosides and/or nucleotides, e.g., as it relates to the natural ribonucleotides A, U, G, and C. Noncanonical nucleotides such as the cap structures are not considered "modified" although they may differ from the chemical structure of the A, C, G, U ribonucleotides.

The phrase "nasal potential difference" is used to measure the voltage across the nasal epithelium, which results from transepithelial ion transport and reflects in part CFTR function. The electrophysiologic abnormality in cystic fibrosis was first described 30 years ago and correlates with features of the CF phenotype.

The term "naturally occurring" means existing in nature without artificial aid.

The term "nonhuman vertebrate" includes all vertebrates except *Homo sapiens*, including wild and domesticated species. Examples of non-human vertebrates include, but are not limited to, mammals, such as alpaca, banteng, bison, camel, cat, cattle, deer, dog, donkey, gayal, goat, guinea pig, horse, llama, mule, pig, rabbit, reindeer, sheep water buffalo, and yak.

The term "nucleotide" means natural bases (standard) and modified bases well known in the art. Such bases are generally located at the 1' position of a nucleotide sugar moiety. Nucleotides generally comprise a base, sugar, and a phosphate group. The nucleotides can be unmodified or modified at the sugar, phosphate, and/or base moiety, (also referred to interchangeably as nucleotide analogs, modified nucleotides, non-natural nucleotides, non-standard nucleotides and other; see, for example, Usman and McSwiggen, supra; Eckstein, et al., International PCT Publication No. WO 92/07065; Usman, et al., International PCT Publication No. WO 93/15187; Uhlman & Peyman, supra, all are hereby incorporated by reference herein). There are several examples of modified nucleic acid bases known in the art as summarized by Limbach, et al, Nucleic Acids Res. 22:2183, 1994. Some of the non-limiting examples of base modifications that can be introduced into nucleic acid molecules include: inosine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g., 6-methyluridine), propyne, and others (Burgin, et al., Biochemistry 35:14090, 1996; Uhlman & Peyman, supra). By "modified bases" in this aspect is meant nucleotide bases other than adenine, guanine, cytosine, thymine and uracil at 1' position or their equivalents.

The term "off target" refers to any unintended effect on any one or more target, gene, or cellular transcript.

The term "codon-optimized" means a natural (or purposefully designed variant of a natural) coding sequence which has been redesigned by choosing different codons without altering the encoded protein amino acid sequence increasing the protein expression levels (Gustafsson et al, Codon bias and heterologous protein expression. 2004, Trends Biotechnol 22: 346-53). Variables such as high codon adaptation index (CAI), LowU method, mRNA secondary structures, cis-regulatory sequences, GC content and many other similar variables have been shown to somewhat correlate with protein expression levels (Villalobos et al., Gene Designer: a synthetic biology tool for constructing artificial DNA segments. 2006, BMC Bioinformatics 7:285). High CAI (codon adaptation index) method picks a most frequently used synonymous codon for an entire protein coding sequence. The most frequently used codon for each amino acid is deduced from 74218 protein-coding genes from a human genome. The LowU method targets only Li-containing codons that can be replaced with a synonymous codon with fewer U moieties. If there are a few choices for the replacement, the more frequently used codon will be selected. The remaining codons in the sequence are not changed by the LowU method. This method may be used in conjunction with the disclosed mRNAs to design coding sequences that are to be synthesized with 5-methoxy uridine.

The term "open reading frame" or "ORF" to a nucleic acid sequence (DNA or RNA) which is capable of encoding a polypeptide of interest. ORFs often begin with the start codon ATG, and end with a nonsense or termination codon or signal.

The phrase "operably linked" refers to a functional connection between two or more molecules, constructs, transcripts, entities, moieties or the like.

The term "patient" refers to a subject who may seek or be in need of treatment, requires treatment, is receiving treatment, will receive treatment, or a subject who is under care by a trained professional for a particular disease or condition.

The phrase "optionally substituted X" (e.g., optionally substituted alkyl) is intended to be equivalent to "X, wherein X is optionally substituted" (e.g., "alkyl, wherein said alkyl is optionally substituted"). It is not intended to mean that the feature "X" (e.g. alkyl) per se is optional.

The term "peptide" is less than or equal to 50 amino acids long, e.g., about 5, 10, 15, 20, 25, 30, 35, 40, 45, or 50 amino acids long.

The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

The phrase "pharmaceutically acceptable excipient," as used herein, refers any ingredient other than the compounds described herein (for example, a vehicle capable of suspending or dissolving the active compound) and having the properties of being substantially nontoxic and non-inflammatory in a patient. Excipients may include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspensing or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, crosslinked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

The phrase "pharmaceutically acceptable salts" refers to derivatives of the disclosed compounds wherein the parent compound is modified by converting an existing acid or base moiety to its salt form (e.g., by reacting the free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. The pharmaceutically acceptable salts of the present disclosure include the conventional non-toxic salts of the parent compound formed, for example, from non-toxic inorganic or organic acids. The pharmaceutically acceptable salts of the present disclosure can be synthesized from the parent compound which contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, nonaqueous media like ether, ethyl acetate, ethanol, isopropanol, or acetonitrile are preferred. Lists of suitable salts are found in *Remington's Pharmaceutical Sciences,* $17^{th}$ ed., Mack Publishing Company, Easton, Pa., 1985, p. 1418, *Pharmaceutical Salts: Properties, Selection, and Use*, P. H. Stahl and C. G. Wermuth (eds.), Wiley-VCH, 2008, and Berge et al., *Journal of Pharmaceutical Science,* 66, 1-19 (1977), each of which is incorporated herein by reference in its entirety.

The term "pharmacokinetic" refers to any one or more properties of a molecule or compound as it relates to the determination of the fate of substances administered to a living organism. Pharmacokinetics is divided into several areas including the extent and rate of absorption, distribution, metabolism and excretion. This is commonly referred to as ADME where: (A) Absorption is the process of a substance entering the blood circulation; (D) Distribution is the dispersion or dissemination of substances throughout the fluids and tissues of the body; (M) Metabolism (or Biotransformation) is the irreversible transformation of parent compounds into daughter metabolites; and (E) Excretion (or Elimination) refers to the elimination of the substances from the body. In rare cases, some drugs irreversibly accumulate in body tissue.

The term "pharmaceutically acceptable solvate," as used herein, means a compound of the disclosure wherein molecules of a suitable solvent are incorporated in the crystal lattice. A suitable solvent is physiologically tolerable at the dosage administered. For example, solvates may be prepared by crystallization, recrystallization, or precipitation from a solution that includes organic solvents, water, or a mixture thereof. Examples of suitable solvents are ethanol, water (for example, mono-, di-, and ti-hydrates), N-methylpyrrolidinone (NMP), dimethyl sulfoxide (DMSO), N,N'-dimethylformamide (DMF), N,N'-dimethylacetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate."

The term "physicochemical" means of or relating to a physical and/or chemical property.

The term "phosphate" is used in its ordinary sense as understood by those skilled in the art and includes its protonated forms, for example

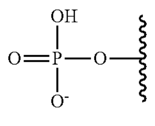
and
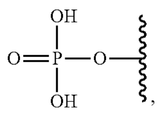
,

As used herein, the terms "monophosphate," "diphosphate," and "triphosphate" are used in their ordinary sense as understood by those skilled in the art, and include protonated forms.

The term "phosphorothioate" refers to a compound of the general formula

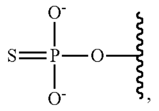

its protonated forms, for example,

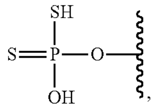

and its tautomers such as

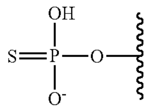

and

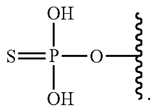

The term "preventing" refers to partially or completely delaying onset of an infection, disease, disorder and/or condition; partially or completely delaying onset of one or more symptoms, features, or clinical manifestations of a particular infection, disease, disorder, and/or condition; partially or completely delaying onset of one or more symptoms, features, or manifestations of a particular infection, disease, disorder, and/or condition; partially or completely delaying progression from an infection, a particular disease, disorder and/or condition; and/or decreasing the risk of developing pathology associated with the infection, the disease, disorder, and/or condition.

The term "protein cleavage site" refers to a site where controlled cleavage of the amino acid chain can be accomplished by chemical, enzymatic or photochemical means.

The phrase "protein cleavage signal" refers to at least one amino acid that flags or marks a polypeptide for cleavage.

The term "proteins of interest" or "desired proteins" include those provided herein and fragments, mutants, variants, and alterations thereof.

The terms "purify," "purified," "purification" means to make substantially pure or clear from unwanted components, material defilement, admixture or imperfection.

The term "RNA" means a molecule comprising at least one ribonucleotide residue. By "ribonucleotide" is meant a nucleotide with a hydroxyl group at the 2' position of a β-D-ribo-furanose moiety. The terms includes double-stranded RNA, single-stranded RNA, isolated RNA such as partially purified RNA, essentially pure RNA, synthetic RNA, recombinantly produced RNA, as well as altered RNA that differs from naturally occurring RNA by the addition, deletion, substitution, and/or alteration of one or more nucleotides. Such alterations can include addition of non-nucleotide material, such as to the end(s) of an interfering RNA or internally, for example at one or more nucleotides of the RNA. Nucleotides in the RNA molecules of the instant disclosure can also comprise non-standard nucleotides, such as non-naturally occurring nucleotides or chemically synthesized nucleotides or deoxynucleotides. These altered RNAs can be referred to as analogs or analogs of naturally-occurring RNA. As used herein, the terms "ribonucleic acid" and "RNA" refer to a molecule containing at least one ribonucleotide residue, including siRNA, antisense RNA, single stranded RNA, microRNA, mRNA, noncoding RNA, and multivalent RNA.

The term "sample" or "biological sample" refers to a subset of its tissues, cells or component parts (e.g. body fluids, including but not limited to blood, mucus, lymphatic fluid, synovial fluid, cerebrospinal fluid, saliva, amniotic fluid, amniotic cord blood, urine, vaginal fluid and semen). A sample further may include a homogenate, lysate or extract prepared from a whole organism or a subset of its tissues, cells or component parts, or a fraction or portion thereof, including but not limited to, for example, plasma, serum, spinal fluid, lymph fluid, the external sections of the skin, respiratory, intestinal, and genitourinary tracts, tears, saliva, milk, blood cells, tumors, organs. A sample further refers to a medium, such as a nutrient broth or gel, which may contain cellular components, such as proteins or nucleic acid molecule.

The phrase "signal sequences" refers to a sequence which can direct the transport or localization of a protein.

The terms "significant" or "significantly" are used synonymously with the term "substantially."

The phrase "single unit dose" is a dose of any therapeutic administered in one dose/at one time/single route/single point of contact, i.e., single administration event.

The term "similarity" refers to the overall relatedness between polymeric molecules, e.g. between polynucleotide molecules (e.g. DNA molecules and/or RNA molecules) and/or between polypeptide molecules. Calculation of percent similarity of polymeric molecules to one another can be performed in the same manner as a calculation of percent identity, except that calculation of percent similarity takes into account conservative substitutions as is understood in the art.

The term "solvate" means a physical association of a compound of this disclosure with one or more solvent molecules. This physical association involves varying degrees of ionic and covalent bonding, including hydrogen bonding. In certain instances, the solvate will be capable of isolation, for example when one or more solvent molecules are incorporated in the crystal lattice of the crystalline solid. "Solvate" encompasses both solution-phase and isolatable solvates. Non-limiting examples of suitable solvates include ethanolates, methanolates, and the like.

The term "split dose" is the division of single unit dose or total daily dose into two or more doses.

The term "stable" refers to a compound that is sufficiently robust to survive isolation to a useful degree of purity from a reaction mixture, and preferably capable of formulation into an efficacious therapeutic agent.

The terms "stabilize", "stabilized," "stabilized region" means to make or become stable.

The term "substituted" means substitution with specified groups other than hydrogen, or with one or more groups, moieties, or radicals which can be the same or different, with each, for example, being independently selected.

The term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena.

The phrase "substantially equal" relates to time differences between doses, the term means plus/minus 2%.

The phrase "substantially simultaneously" relates to plurality of doses, the term means within 2 seconds.

The phrase "suffering from" relates to an individual who is "suffering from" a disease, disorder, and/or condition has been diagnosed with or displays one or more symptoms of a disease, disorder, and/or condition.

The phrase "susceptible to" relates to an individual who is "susceptible to" a disease, disorder, and/or condition has not been diagnosed with and/or may not exhibit symptoms of the disease, disorder, and/or condition but harbors a propensity to develop a disease or its symptoms. In some embodiments, an individual who is susceptible to a disease, disorder, and/or condition (for example, cancer) may be characterized by one or more of the following: (1) a genetic mutation associated with development of the disease, disorder, and/or condition; (2) a genetic polymorphism associated with development of the disease, disorder, and/or condition; (3) increased and/or decreased expression and/or activity of a protein and/or nucleic acid associated with the disease, disorder, and/or condition; (4) habits and/or lifestyles associated with development of the disease, disorder, and/or condition; (5) a family history of the disease, disorder, and/or condition; and (6) exposure to and/or infection with a microbe associated with development of the disease, disorder, and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

The term "synthetic" means produced, prepared, and/or manufactured by the hand of man. Synthesis of polynucleotides or polypeptides or other molecules of the present disclosure may be chemical or enzymatic.

The term "targeted cells" refers to any one or more cells of interest. The cells may be found in vitro, in vivo, in situ or in the tissue or organ of an organism. The organism may be an animal, preferably a mammal, more preferably a human and most preferably a patient.

The term "therapeutic agent" refers to any agent that, when administered to a subject, has a therapeutic, diagnostic, and/or prophylactic effect and/or elicits a desired biological and/or pharmacological effect.

The term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve symptoms of, diagnose, prevent, and/or delay the onset of the infection, disease, disorder, and/or condition.

The term "therapeutically effective outcome" means an outcome that is sufficient in a subject suffering from or susceptible to an infection, disease, disorder, and/or condition, to treat, improve symptoms of, diagnose, prevent, and/or delay the onset of the infection, disease, disorder, and/or condition.

The term "total daily dose" is an amount given or prescribed in 24 hour period. It may be administered as a single unit dose.

The term "transcription factor" refers to a DNA-binding protein that regulates transcription of DNA into RNA, for example, by activation or repression of transcription. Some transcription factors effect regulation of transcription alone, while others act in concert with other proteins. Some transcription factor can both activate and repress transcription under certain conditions. In general, transcription factors bind a specific target sequence or sequences highly similar to a specific consensus sequence in a regulatory region of a target gene. Transcription factors may regulate transcription of a target gene alone or in a complex with other molecules.

The term "treating" refers to partially or completely alleviating, ameliorating, improving, relieving, delaying onset of, inhibiting progression of, reducing severity of, and/or reducing incidence of one or more symptoms or features of a particular infection, disease, disorder, and/or condition. For example, "treating" cancer may refer to inhibiting survival, growth, and/or spread of a tumor. Treatment may be administered to a subject who does not exhibit signs of a disease, disorder, and/or condition and/or to a subject who exhibits only early signs of a disease, disorder, and/or condition for the purpose of decreasing the risk of developing pathology associated with the disease, disorder, and/or condition.

The term "unmodified" refers to any substance, compound or molecule prior to being changed in any way. Unmodified may, but does not always, refer to the wild type or native form of a biomolecule. Molecules may undergo a series of modifications whereby each modified molecule may serve as the "unmodified" starting molecule for a subsequent modification.

The compounds described herein can be asymmetric (e.g., having one or more stereocenters). All stereoisomers, such as enantiomers and diastereomers, are intended unless otherwise indicated. Compounds of the present disclosure that contain asymmetrically substituted carbon atoms can be isolated in optically active or racemic forms. Methods on how to prepare optically active forms from optically active starting materials are known in the art, such as by resolution of racemic mixtures or by stereoselective synthesis. Many geometric isomers of olefins, C═N double bonds, and the like can also be present in the compounds described herein, and all such stable isomers are contemplated in the present disclosure. Cis and trans geometric isomers of the compounds of the present disclosure are described and may be isolated as a mixture of isomers or as separated isomeric forms.

Compounds of the present disclosure also include tautomeric forms. Tautomeric forms result from the swapping of a single bond with an adjacent double bond and the concomitant migration of a proton. Tautomeric forms include prototropic tautomers which are isomeric protonation states having the same empirical formula and total charge. Examples prototropic tautomers include ketone-enol pairs, amide-imidic acid pairs, lactam-lactim pairs, amide-imidic acid pairs, enamine-imine pairs, and annular forms where a proton can occupy two or more positions of a heterocyclic system, such as, 1H- and 3H-imidazole, 1H-, 2H- and 4H-1,2,4-triazole, 1H- and 2H-isoindole, and 1H- and 2H-pyrazole. Tautomeric forms can be in equilibrium or sterically locked into one form by appropriate substitution.

Compounds of the present disclosure also include all of the isotopes of the atoms occurring in the intermediate or final compounds. "Isotopes" refers to atoms having the same atomic number but different mass numbers resulting from a different number of neutrons in the nuclei. For example, isotopes of hydrogen include tritium and deuterium.

The compounds and salts of the present disclosure can be prepared in combination with solvent or water molecules to form solvates and hydrates by routine methods.

The term "half-life" is the time required for a quantity such as nucleic acid or protein concentration or activity to fall to half of its value as measured at the beginning of a time period.

The term "in vitro" refers to events that occur in an artificial environment, e.g., in a test tube or reaction vessel, in cell culture, in a Petri dish, etc., rather than within an organism (e.g., animal, plant, or microbe).

The term "in vivo" refers to events that occur within an organism (e.g., animal, plant, or microbe or cell or tissue thereof).

The term "monomer" refers to a single unit, e.g., a single nucleic acid, which may be joined with another molecule of the same or different type to form an oligomer. In some embodiments, a monomer may be an unlocked nucleic acid, i.e., a UNA monomer.

The term "neutral lipid" means a lipid species that exist either in an uncharged or neutral zwitterionic form at a selected pH. At physiological pH, such lipids include, for example, diacylphosphatidylcholine, diacylphosphatidylethanolamine, ceramide, sphingomyelin, cephalin, cholesterol, cerebrosides, and diacylglycerols.

The term "non-cationic lipid" means an amphipathic lipid or a neutral lipid or anionic lipid and is described herein.

The term "oligomer" may be used interchangeably with "polynucleotide" and refers to a molecule comprising at least two monomers and includes oligonucleotides such as DNAs and RNAs. In the case of oligomers containing RNA monomers and/or unlocked nucleic acid (UNA) monomers, the oligomers of the present disclosure may contain sequences in addition to the coding sequence (CDS). These additional sequences may be untranslated sequences, i.e., sequences which are not converted to protein by a host cell. These untranslated sequences can include a 5' cap, a 5' untranslated region (5' UTR), a 3' untranslated region (3' UTR), and a tail region, e.g., a poly-A tail region. As described in further detail herein, any of these untranslated sequences may contain one or more UNA monomers—these UNA monomers are not capable of being translated by a host cell's machinery. In the context of the present disclosure, a "mRNA sequence," a "mRNA sequence," "translatable polynucleotide," or "translatable compound" refers to a sequence that comprises a region, e.g., the coding region of an RNA (e.g., the coding sequence of human CFTR or a codon-optimized version thereof), that is capable of being converted to a protein or a fragment thereof, e.g., the human CFTR protein or a fragment thereof.

The terms "subject" or "patient" refers to any organism to which a composition in accordance with the disclosure may be administered, e.g., for experimental, diagnostic, prophylactic, and/or therapeutic purposes. Typical subjects include animals (e.g., mammals such as mice, rats, rabbits, non-human primates, and humans) and/or plants.

The term "translatable" may be used interchangeably with the term "expressible" and refers to the ability of polynucleotide, or a portion thereof, to be converted to a polypeptide by a host cell. As is understood in the art, translation is the process in which ribosomes in a cell's cytoplasm create polypeptides. In translation, messenger RNA (mRNA) is decoded by tRNAs in a ribosome complex to produce a specific amino acid chain, or polypeptide. Furthermore, the term "translatable" when used in this specification in reference to an oligomer, means that at least a portion of the oligomer, e.g., the coding region of an oligomer sequence (also known as the coding sequence or CDS), is capable of being converted to a protein or a fragment thereof.

The term "translation efficiency" refers to a measure of the production of a protein or polypeptide by translation of an mRNA sequence in vitro or in vivo. [0080] This disclosure provides a range of mRNA sequence molecules, which can contain one or more UNA monomers, and a number of nucleic acid monomers, wherein the mRNA sequence can be expressible to provide a polypeptide or protein.

Therapeutically effective outcome: As used herein, the term "therapeutically effective outcome" means an outcome that is sufficient in a subject suffering from or susceptible to an infection, disease, disorder, and/or condition, to treat, improve symptoms of, diagnose, prevent, and/or delay the onset of the infection, disease, disorder, and/or condition.

The term "unit dose" refers to a discrete amount of the pharmaceutical composition comprising a predetermined amount of the active ingredient. The amount of the active ingredient may generally be equal to the dosage of the active ingredient which would be administered to a subject and/or a convenient fraction of such a dosage including, but not limited to, one-half or one-third of such a dosage.

EXAMPLES

The present disclosure is further described in the following examples, which do not limit the scope of the disclosure described in the claims.

Example 1: Preparation of hCFTR mRNA Lipid Formulations

This example provides general methods for the preparation of mRNA constructs, mRNA-lipid formulations, and methods for characterizing the same.

In Vitro Transcription Protocol

Constructs of hCFTR mRNAs were synthesized in vitro using T7RNA polymerase-mediated DNA-dependent RNA transcription. In the transcription reaction, modified and unmodified uridine triphosphates (UTP) were used depending on the desired polynucleotide configuration. Modified UTPs that were used included 5-methoxy-UTP (5MeOU), $N^1$-methyl pseudo UTP (N1MPU), $N^1$-methoxy methyl pseudo UTP (N1-MOM), 5-hydroxy methyl UTP, 5-carboxy UTP, and a mixture of modifications using a linearized template for each UTR combination. The mRNA was purified using column chromatography, whereby the DNA template and double stranded RNA contamination of all mRNAs synthesized was removed using an enzymatic reaction. Then, the mRNA was concentrated, and buffer exchanged.

The mRNA constructs also included a 5' $m^7$GpppGm cap and a poly-A tail from about 80 to about 125 adenine nucleotides in length.

Preparation of Lipid Encapsulated mRNA

Lipid encapsulated mRNA particles were prepared by mixing lipids (ionizable cationic lipid: DSPC: Cholesterol: PEG-DMG) in ethanol with different CFTR mRNAs described herein (specific formulations are described in subsequent Examples) dissolved in Citrate buffer. The ionizable cationic lipids used in the formulation were selected lipids of Formula I described hereinabove. The mixed material was instantaneously diluted with Phosphate Buffer. Ethanol was removed by dialysis against phosphate buffer using a regenerated cellulose membrane (100 kD MWCO) or by tangential flow filtration (TFF) using modified polyehtersulfone (mPES) hollow fiber membranes (100 kD MWCO). Once the ethanol was completely removed, the buffer was exchanged with HEPES (4-(2-hydroxyethyl)-1-piperazineethanesulfonic acid) buffer containing 40-60 mM NaCl and 7-12% sucrose, pH 7.3. The formulation was concentrated and followed by a 0.2 μm filtration using PES filters. The mRNA concentration in the formulation was then measured by Ribogreen fluorimetric assay following which the concentration was adjusted to a final desired concentration by diluting with HEPES buffer at pH 7.3 containing 40-60 mM NaCl, 7-12% sucrose, and further containing glycerol. The final formulation was then filtered through a 0.2 μm filter and filled into glass vials, stoppered, capped, and stored at −70±5° C. The frozen formulations were characterized for their mRNA content and percent encapsulation by a RiboGreen assay, mRNA integrity by fragment analyzer, lipid content by high performance liquid chromatography (HPLC), particle size by dynamic light scattering on a Malvern Zetasizer Nano ZS, pH, and osmolality.

In-Cell Western (ICW)

An In-Cell Western (ICW) assay was developed to assess the potency and ability of the mRNA lipid formulations to transfect cells and express a protein of interest. In the assay, a 96-well collagen plate was used to seed the cells at the appropriate density in Dulbecco's Modified Eagle Medium (DMEM) containing Fetal Bovine Serum (FBS). At the optimal confluence, cells were transfected with the targeted mRNAs diluted in the transfection reagent mix (MessengerMax™ and Opti-MEM®). The cells were placed in a $CO_2$ incubator and allowed to grow. At the desired timepoint, media was removed, and the cells were fixed in 4% fresh paraformaldehyde (PFA) for 20 min. After that, fixative was removed, and the cells were permeabilized several times in Tris-buffered saline with TWEEN (TBST) for 5 minutes each time. When the permeabilization washes were complete, the cells were incubated with a blocking buffer (ODYSSEY® Blocking Buffer (PBS) (LI-COR, Lincoln, NE)) for 45 minutes. A primary antibody was then added and incubated for 1 hour at room temperature. The cells were then washed several times in TBST and incubated for 1 hour with a secondary antibody diluted in blocking buffer and containing a CELLTAG 700 stain. Finally, the cells were washed several times in TBST followed by a last wash in Tris-buffered saline TBS. The plate was imaged using the LI-COR® detection system, and the data was normalized to the total number of cells labeled by the CELLTAG 700. Specific results of ICW assays are discussed hereinbelow.

Example 2: Ex Vivo Lung Explant Protocol

Studies were performed to assess the ability of the CFTR mRNA-lipid formulations prepared as described in Example 1 to express in human lungs. This example provides a general description of the materials and methods of the protocol for human lung explant studies.

Human lung explants, both from non-CF individuals and from individuals having CF, were received from the National Development and Research Institutes, Inc. (NDRI). All the handling and processing up to obtaining a slice culture was done under BSL-2 conditions. Briefly, the lungs were wiped out and insufflated with 1.5% low melting point agarose. Then, a conical piece was excised using a coring tool, a block was generated, and 250 μm slices were cut using a slice microtome. The slices were cultured in a Dulbecco's Modified Eagle Medium (DMEM) culture medium. After several washes to remove excess agarose, DMEM culture medium was added, including the proper antibiotics for the lung type being tested (i.e., CF or non-CF), and the slices were cultured with the different CFTR mRNA-lipid formulations as prepared in Example 1. 24 hours post transduction, the slices were homogenized and prepared for Western Blot (WB) analysis. Cell viability measurements were performed using a Lactate Dehydrogenase (LDH) kit (ThermoFisher Scientific) to assure viability of the slices in culture. For the non-CF lungs, the antibiotics included of penicillin and streptomycin. For the CF lungs, the antibiotics included amphotericin, ceftazidime, tobramycin, vancomycin, ciprofloxacin, coly-mycin, sulfamethoxazole, fluconazole, nystatin, antibiotic-antimycotic, tetracycline hydrochloride, rifampicin, and azithromycin.

Example 3: Screening of CFTR Sequences

Codon-optimized sequences were designed based on the natural human CFTR sequence (hCFTR) and studies were performed to compare the translation efficiency of the various sequences. In these studies, unformulated hCFTR mRNAs were transfected into CF bronchial epithelial (CFBE) cells. CFBE is an immortalized cell line created from the bronchial epithelium of a CF patient homozygous for the F508 deletion. CFBE cells have been used to study CFTR function and response to small molecules due to their clinical relevance to CF and their ability to polarize and form tight junctions.

Twenty-four (24) hours post-transfection, expression levels for the various hCFTR mRNAs were determined by In-Cell and On-Cell Western assay (ICW, OCW) using a human CFTR antibody. The correlation between both assays was plotted and the results are shown in FIG. 1. In this figure, "Unt" represents an untransfected negative control, which formed the baseline for this study. The various hCFTR mRNA constructs were ranked based on their respective expression profiles. Highest expressers (grey dots), low-to-medium expressers (black dots), native sequence (grey square) and baseline (Unt) are plotted as shown in FIG. 1. It can be seen that constructs 2099.1 (SEQ ID NO: 72), 1835.1 (SEQ ID NO: 53), 2095.1 (SEQ ID NO: 68), 2096.1 (SEQ ID NO: 69), and 2093.1 (SEQ ID NO: 66) all showed superior expression levels. "0.1" for these constructs indicates that the mRNA was synthesized with 100% of the uridines being N1MPU. The constructs further comprised a 5' cap and a poly-A tail as described in Example 1.

Example 4: UTR/ORF Combinations Identified in Transfected CFBE Cells

Figure 2:
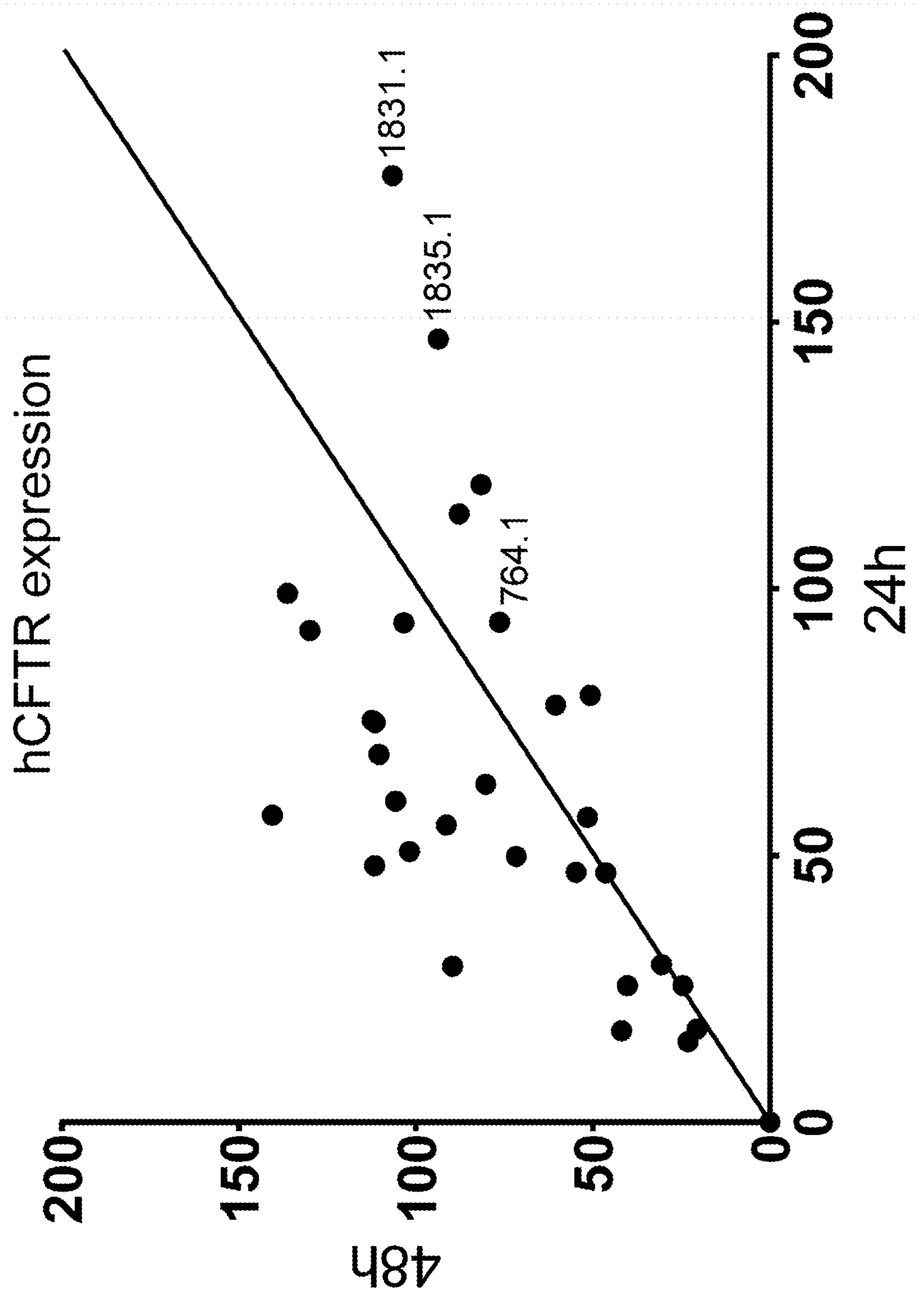
FIG. 2 shows expression levels of UTR-optimized hCFTR mRNA sequences measured at 24 hours and 48 hours post transfection by ICW using a hCFTR specific antibody as described in Example 4.

Additional hCFTR constructs were prepared to assess the effect of different UTRs on the expression levels of the hCFTR mRNA. The coding region for each of the hCFTR constructs contained a reference sequence taken from the coding region of SEQ ID NO: 47, which is a commonly used mRNA sequence for wild-type hCFTR that has been slightly changed by introducing a point mutation to remove a cryptic promoter region. (Chow et al., (1997) *PNAS* 94: 14695-14700). A UTR library was designed for the reference sequence coding region in which selected UTRs were combined with the reference sequence coding region. The unformulated UTR-optimized hCFTR mRNA sequences were then tested in vitro by transfecting CFBE cells. Expression levels were measured at 24 hours and 48 hours post transfection by using a hCFTR specific antibody and the ICW assay described in Example 1. The results are shown in FIG. 2, which is a correlation plot of the expression levels for the various constructs at 24 hours and 48 hours post transfection. In comparison to the negative control of the reference sequence (construct 764.1, also designated SEQ ID NO: 47), it can be seen that the constructs 1835.1 (SEQ ID NO: 53) and 1831.1 (SEQ ID NO: 49) showed especially superior expression levels. These constructs included a 5' UTR of SEQ ID NO: 106 (TEV), which indicates that this UTR unexpectedly enhances hCFTR expression.

Example 5: C-Band CFTR Protein Levels In Vitro

Figure 3:
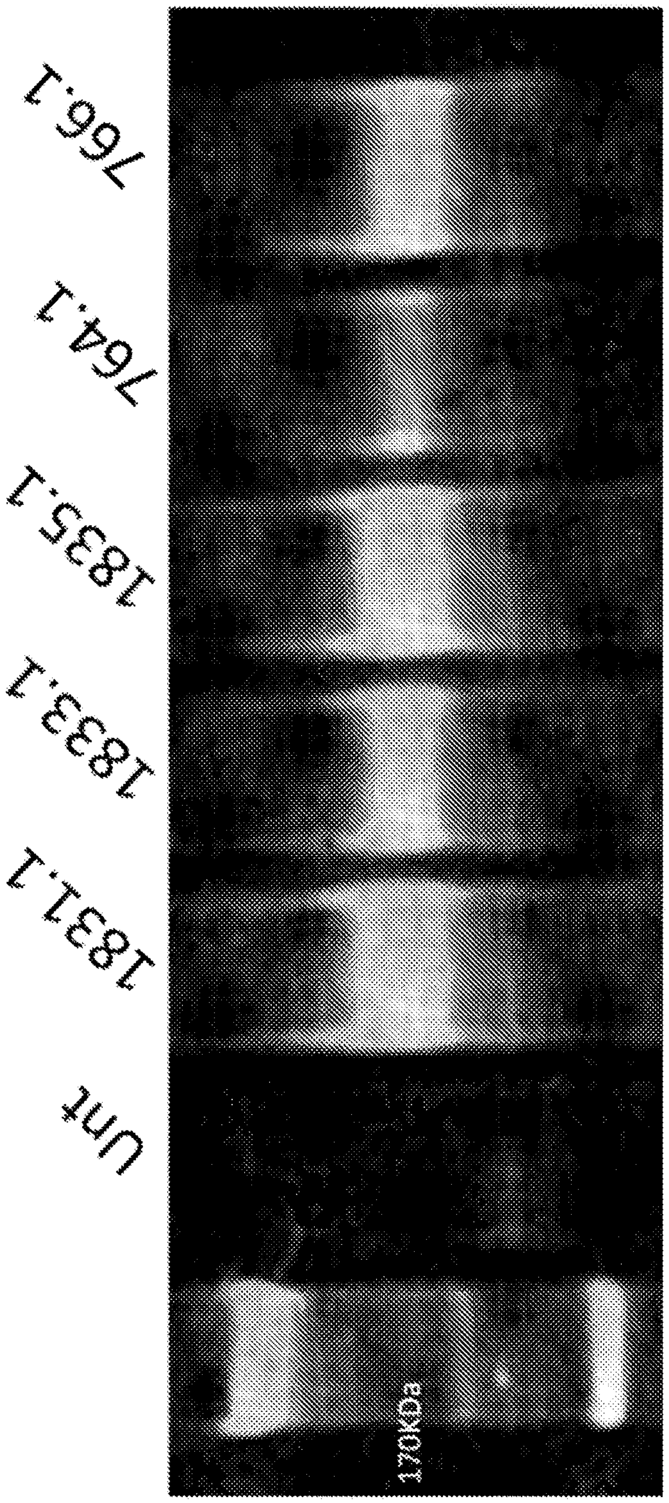
FIG. 3 shows C-band (fully mature and glycosylated) CFTR protein levels expressed in vitro with different codon-optimized hCFTR mRNAs analyzed using Western Blot (WB) as described in Example 5.
Figure 4:
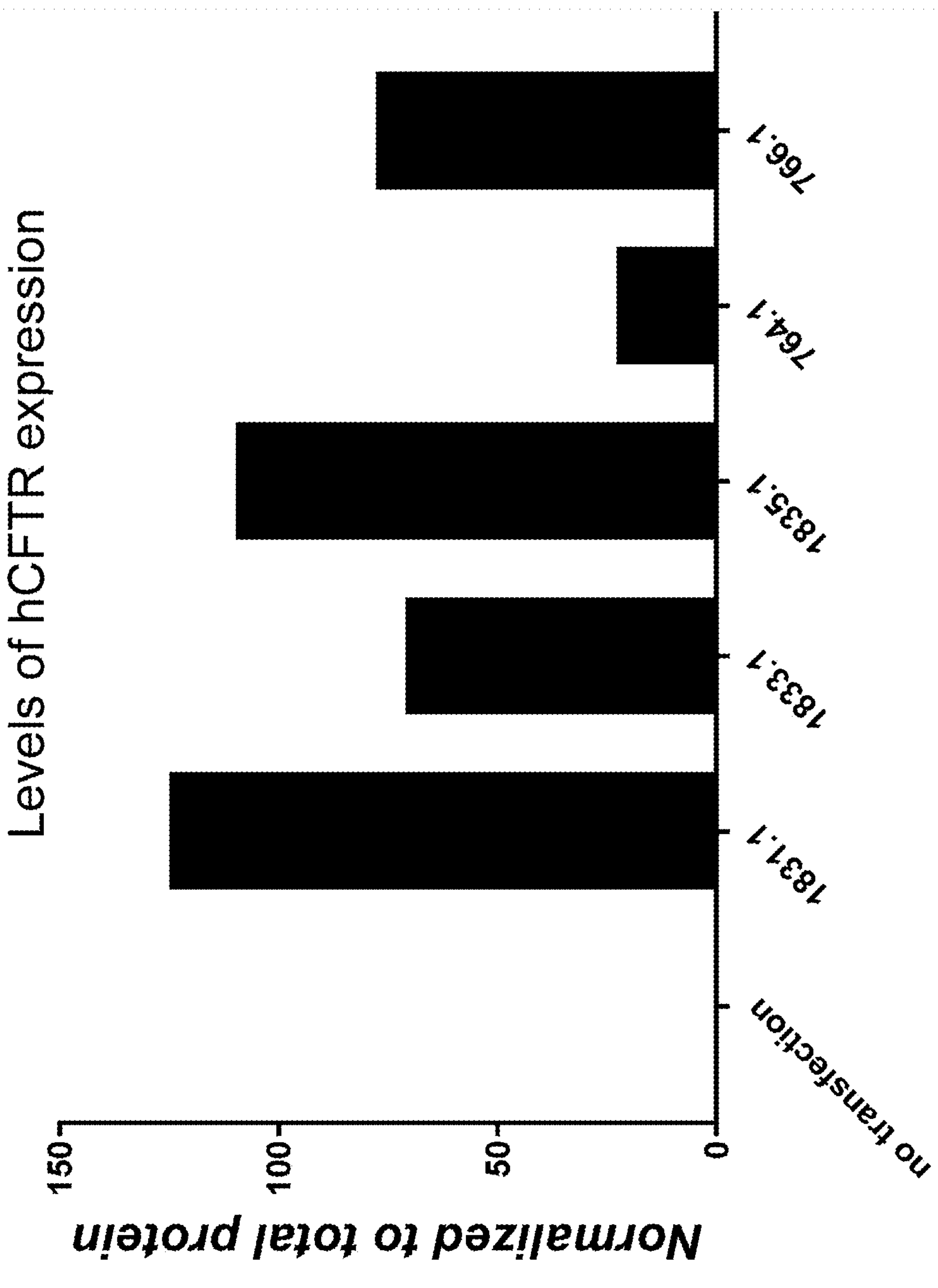
FIG. 4 shows expression levels measured by quantifying the C-band using Western Blot as described in Example 5.

Further studies were conducted to compare the expression of various hCFTR mRNA constructs relative to a reference sequence mRNA. The constructs tested were 1831.1 (SEQ ID NO: 49), 1833.1 (SEQ ID NO: 51), 1835.1 (SEQ ID NO: 53), 766.1 (SEQ ID NO: 48), and the reference sequence construct of 764.1 (wild-type hCFTR mRNA; SEQ ID NO: 47). CFBE cells were transfected with unformulated codon-optimized hCFTR and reference sequence mRNAs, and further analyzed for protein levels using a Western Blot (WB) assay using a primary antibody specific for hCFTR. The results are shown in FIG. 3. The degree of expression was measured by quantifying the C-band (located at a molecular weight of about 170 kDa), which represents a fully-glycosylated, mature CFTR protein, and the results are graphed in FIG. 4. It can be seen in FIGS. 3 and 4 that all codon-optimized hCFTR mRNAs analyzed (SEQ ID NOs: 49, 51, 53, 48), showed higher protein expression levels (more intense signal) over the reference sequence (SEQ ID NO: 47). The lane labeled “Unt” represents the negative control of cells which were untransfected, and as expected no C-band was detected in this sample.

Example 6: Transfected hCFTR mRNA is Fully Glycosylated

Further experiments were conducted to ensure that the proteins expressed by the hCFTR mRNAs were completely processed into a fully mature CFTR protein. As a membrane bound protein, CFTR’s biogenesis carries it through the endoplasmic reticulum (ER) and Golgi apparatus. Within the ER the CFTR polypeptide is core glycosylated at two sites and then within the Golgi apparatus it receives complex glycosylation that is maintained at the level of the plasma membrane. When evaluated on a Western blot the core glycosylated immature form of CFTR migrates further and is designated the “B-band.” The complex glycosylated form of CFTR, representing transit through the Golgi, but not necessarily plasma membrane expression, migrates slower during gel electrophoresis due to its greater molecular weight and is termed “C-band.” Complex glycosylation of the CFTR protein is important as it appears to play a role in prolonging membrane stability. This is supported by the observation that the F508del CFTR protein shows a marked drop in the level of “C-band” as observed in Western blot assays. (J. Cell Sci., 2008. 121(Pt 17): p. 2814-23). Typically, the A-band is observed at a molecular weight of about 130-140 kDa, and corresponds to an immature, incompletely-glycosylated form of CFTR. The B-band is also typical of an incompletely glycosylated (“core glycosylated”) CFTR and is observed at a molecular weight of about 150 kDa. In contrast, the fully mature and glycosylated CFTR protein is identified in the C-band, which corresponds to a molecular weight of about 170 kDa.

Figure 5:
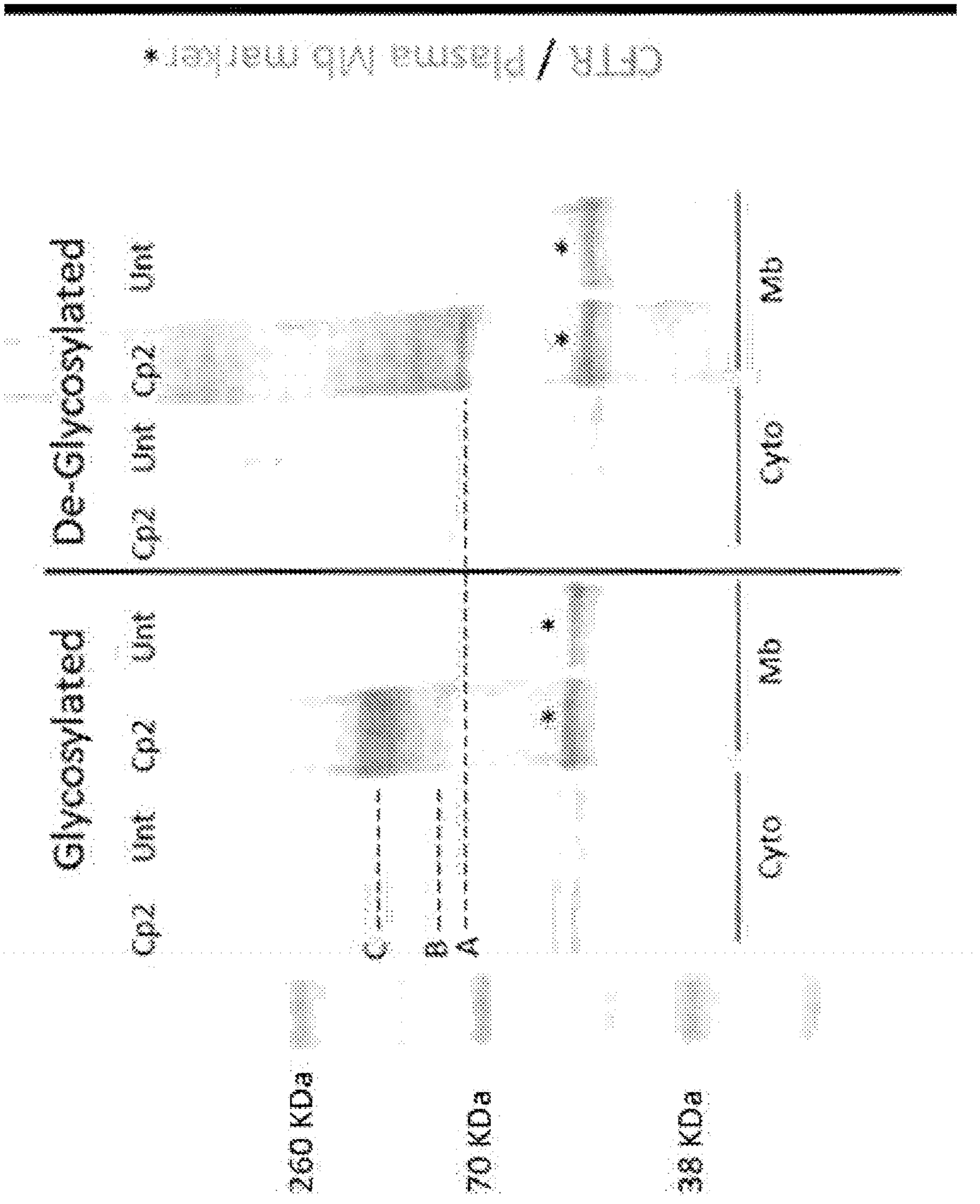
FIG. 5 shows hCFTR-specific band expression levels for cytosolic (Cyto) and membrane (Mb) fractions collected from cells transfected by hCFTR mRNA and analyzed by Western Blot (WB) using a primary antibody specific for hCFTR and for plasma membranes (sodium potassium ATPase) as described in Example 6.

In this study, CFBE cells were transfected with an unformulated codon-optimized hCFTR mRNA (SEQ ID NO: 53). Samples were fractionated into a cytosolic fraction (Cyto) and membrane (Mb) fraction. The fractions of one sample set underwent a deglycosylation process (Deglycosylated) while the fractions of another sample set did not receive this treatment (Glycosylated). The two sample sets were then analyzed for protein expression levels by Western Blot (WB) using a primary antibody specific for hCFTR and for the plasma membrane fraction (sodium potassium ATPase). The results of the WB assay are shown in FIG. 5. As seen in this figure, no hCFTR-specific bands were found in the cytosolic fractions (Cyto) for both the glycosylated and deglycosylated sample sets. hCFTR-specific bands were found in the membrane fractions (Mb) for both sample sets. However, the glycosylated sample set showed a small amount of protein in the B-band, with the majority of protein in the fully-glycosylated C-band and no protein in the A-band, whereas deglycosylated samples showed a significant amount of protein in the unglycosylated A-band and no protein in the B- or C-bands. These results indicate that the codon-optimized hCFTR mRNA is mainly expressing the mature, fully-glycosylated hCFTR protein, with hCFTR completely translocating to the cellular membrane.

Example 7: Confocal Immunofluorescence of hCFTR In Vitro

Figure 6:
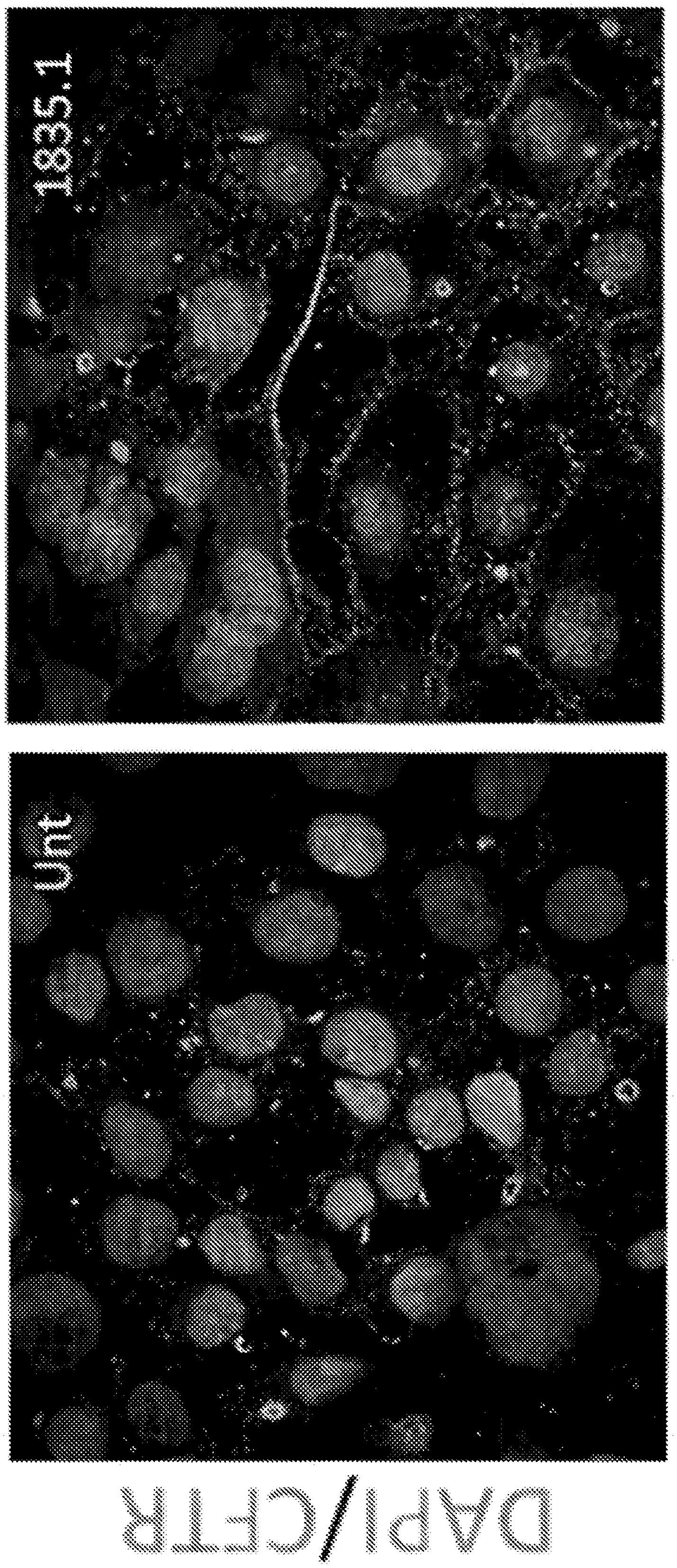
FIG. 6 shows confocal immunofluorescence images of CFBE cells transfected with a codon-optimized hCFTR mRNA (SEQ ID NO: 53) and processed for immunofluorescence using an antibody specific for hCFTR protein as described in Example 7.

Confocal Immunofluorescence microscopy was used to determine whether hCFTR protein expressed by the mRNAs described herein was located in the plasma membrane of transfected cells. In this experiment, CFBE cells were transfected with a codon-optimized hCFTR mRNA (SEQ ID NO: 53; also designated construct 1835.1) and processed for immunofluorescence using an immunofluorescent-antibody probe specific for hCFTR and DAPI as a counterstain. As a negative control, untransfected cells (Unt) were also processed with immunofluorescent-antibody probe specific for hCFTR and DAPI as a counterstain. The DAPI counterstain is indicative of cellular nuclei. The fluorescent images are shown in FIG. 6. In these images, both the untransfected sample (left panel) and the sample transfected with codon-optimized hCFTR mRNA showed several large round structures corresponding to cellular nuclei, as seen by DAPI counterstaining. In contrast, the immunofluorescence associated with the immunofluorescent antibody probe specific for hCFTR showed an even distribution spaced away from the counterstained nuclei only in the image for the hCFTR mRNA transfected cells. This indicates that the hCFTR protein was located in the plasma membrane of transfected cells and agrees with the results described in Example 6.

Example 8: Dose Response of hCFTR mRNAs in Transfected FRT Cells

Figure 7:
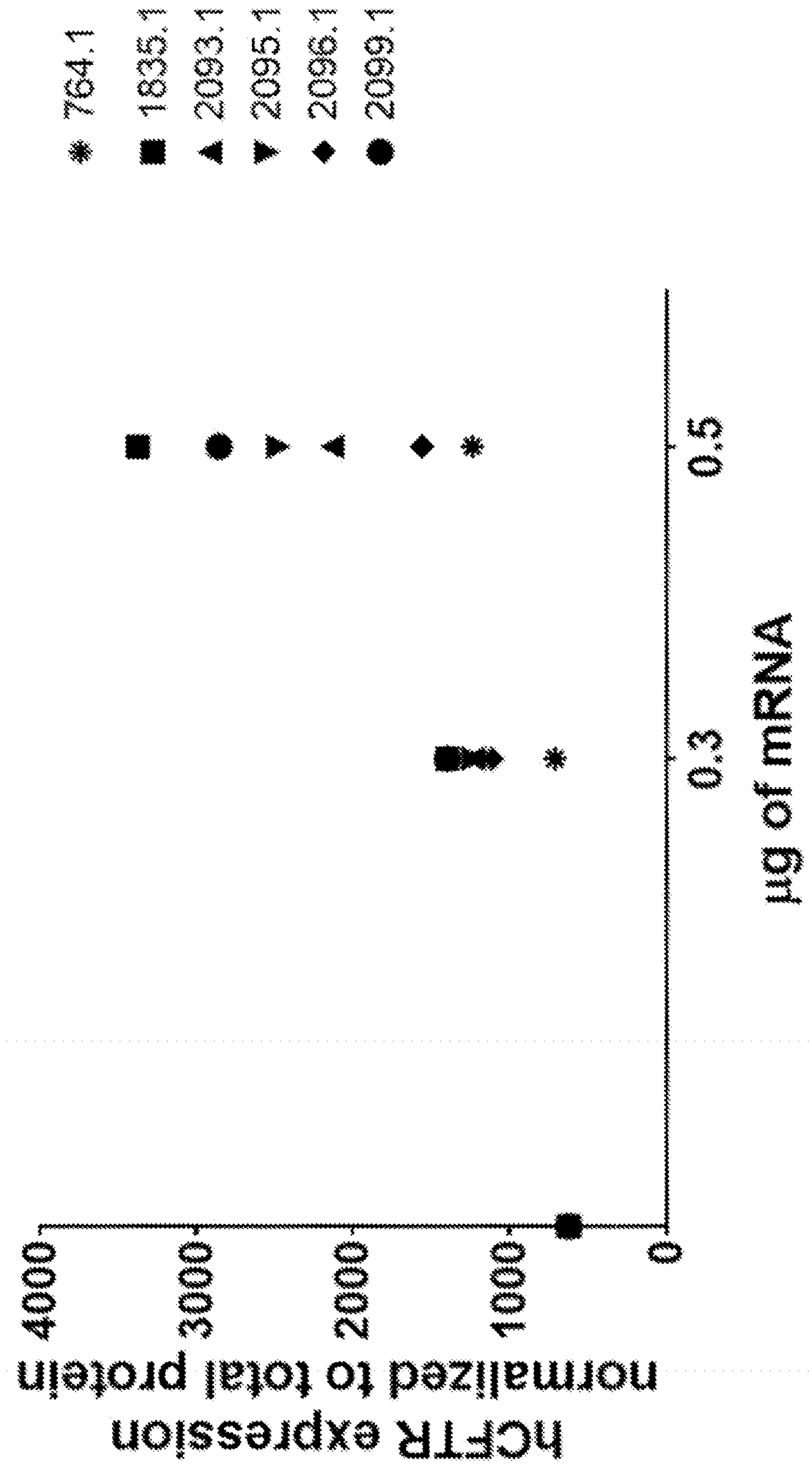
FIG. 7 shows the dose response for protein expression of different hCFTR mRNAs in transfected FRT cells as described in Example 8.

The expression of hCFTR for selected codon-optimized mRNA constructs was studied as a function of aliquot level. In this study, FRT (Fischer rat thyroid gland) cells were transfected with unformulated aliquots of 0 μg, 0.3 μg and 0.5 μg for each of the selected codon-optimized hCFTR mRNAs and the reference sequence (SEQ ID NO: 47, construct 764.1). The hCFTR constructs used in this study were 1835.1 (SEQ ID NO: 53), 2093.1 (SEQ ID NO: 66), 2095.1 (SEQ ID NO: 68), 2096.1 (SEQ ID NO: 69), and 2099.1 (SEQ ID NO: 72). After transfection, protein lysates were analyzed by WB as described in previous examples. C-band levels were analyzed and plotted for each of the constructs at each aliquot level. The results are presented in FIG. 7. At both the 0.3 μg and 0.5 μg levels, all codon-optimized constructs showed better expression than the reference sequence. It can also be seen that expression levels were relatively similar for the codon-optimized constructs the 0.3 μg level. However, at the 0.5 μg level, clear differences could be seen among the various codon-optimized constructs, and the constructs ranked differently based on their C-band protein expression levels, with SEQ ID NO: 53 being the highest C-band expressing construct, as shown in FIG. 7.

Figure 8:
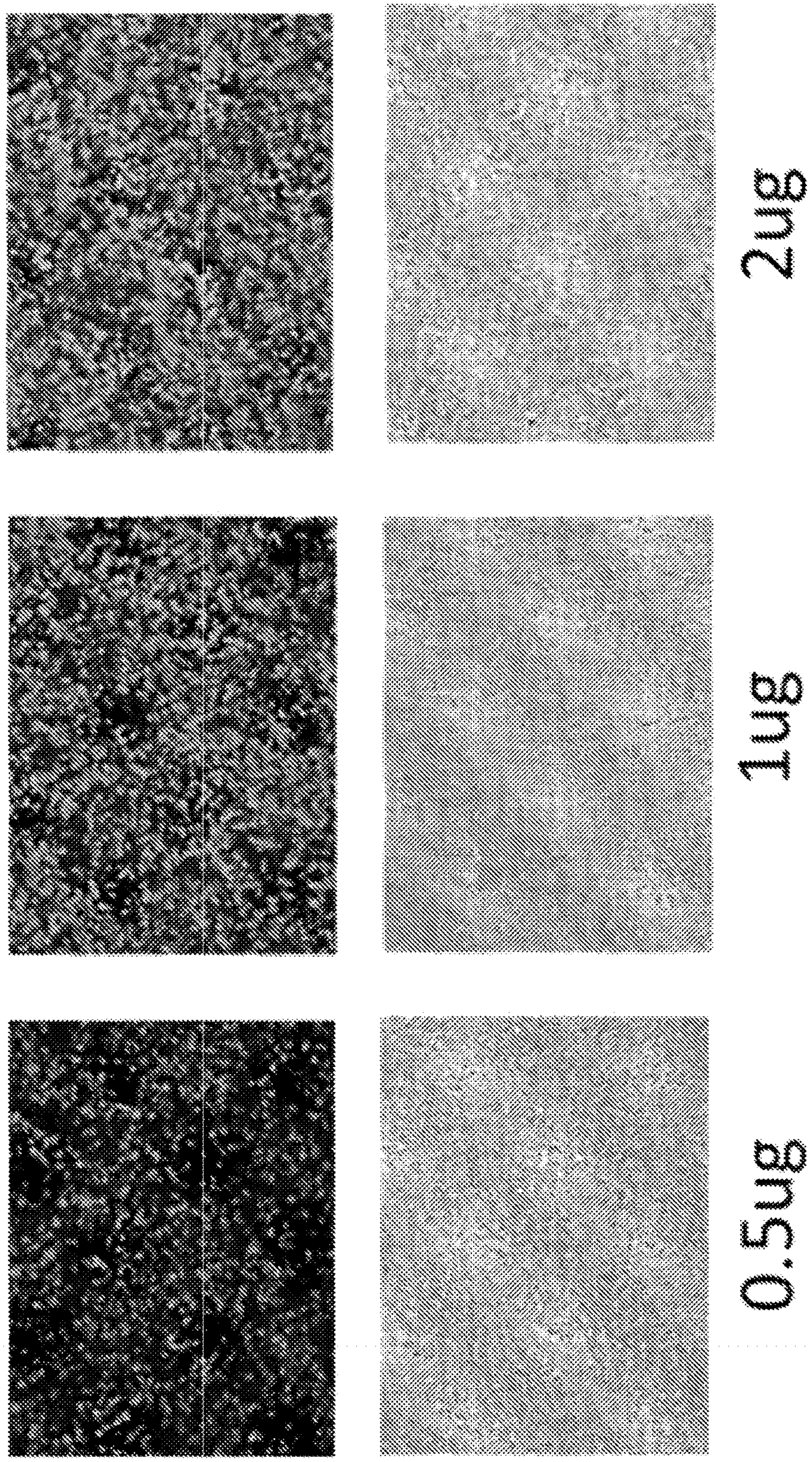
FIG. 8 shows transfection efficiency in FRT cells transfected with mCherry mRNA as described in Example 9. The panels on the top show the transfected (mCherry) cells, and the panels on the bottom show untransfected cells.

Example 9: Transfection Efficiency in FRT Cells Transfected with mCherry mRNA To further verify that FRT cells are effectively transfected by mRNAs in a dose-dependent manner, FRT cells were transfected with 0.5 μg, 1 μg, and 2 μg of mRNA expressing the mCherry monomeric red fluorescent protein. 6 hours post transfection, the transfected cells were imaged using confocal fluorescence microscopy. The results are shown in FIG. 8, with top panels showing the fluorescent images for transfected cells at each dose level and the bottom panels showing images for untransfected cells. The transfection efficiency was determined to be 80%, with a dose-dependent increase in mCherry expression as the 5 μg treated cells showed significantly greater fluorescence intensity than the 0.5 μg and 1 μg treated cells. Thus, this experiment confirms that FRT cells are effectively transfected with mRNAs in a dose-dependent manner.

Example 10: Efficacy in FRT Cells Transfected with Selected hCFTR mRNAs

Further studies were conducted to assess the activity of hCFTR proteins expressed by selected mRNA constructs and whether these can properly open and close to allow proper ion transport. In these studies, an Air-Liquid Interface (ALI) cell culture model of FRT cells was used to transfect an unformulated subset of codon-optimized hCFTR mRNAs at different doses ranging from 0.5 μg-2 μg of mRNA (the 2 μg dose is not shown) into the FRT cells. ALI is a method of cell culture by which polarized cells are generated with their basal surfaces in contact with media, and the top of the cellular layer is exposed to the air. This model helps to mimic the cellular structure of in vivo airways.

At 24 hours post-transfection, transepithelial conductance (Gt) of the cells over time was measured as an indicator of CFTR activity. Initially, Gt was measured with the transfected or control cells unperturbed. Then, a sequential process of CFTR activation (channel opening), enhancement (gating promotion) and closing of the CFTR channels was performed. The hCFTR constructs used in this study were 1835.1 (SEQ ID NO: 53), 2093.1 (SEQ ID NO: 66), 2095.1 (SEQ ID NO: 68), 2096.1 (SEQ ID NO: 69), and 2099.1 (SEQ ID NO: 72). In addition, controls were performed using a reference sequence of construct 764.1 (SEQ ID NO: 47) and untransfected cells. In this process, the cells were first stimulated with Forskolin, a cAMP-dependent CFTR channel activator. Once an equilibrium was reached with the Forskolin, the potentiator VX770 was introduced to further promote gating. Finally, after anew equilibrium was reached with the VX770, Inh-172, a known inhibitor of the CFTR channels, was added. Further information on the protocols used in these measurements can be found in the literature (Schultz et al. (1999) Physiol. Rev., 79:S109-44; Li et al. (2004) J. Cyst. Fibros. Supple. 2:123-6.).

Figure 9:
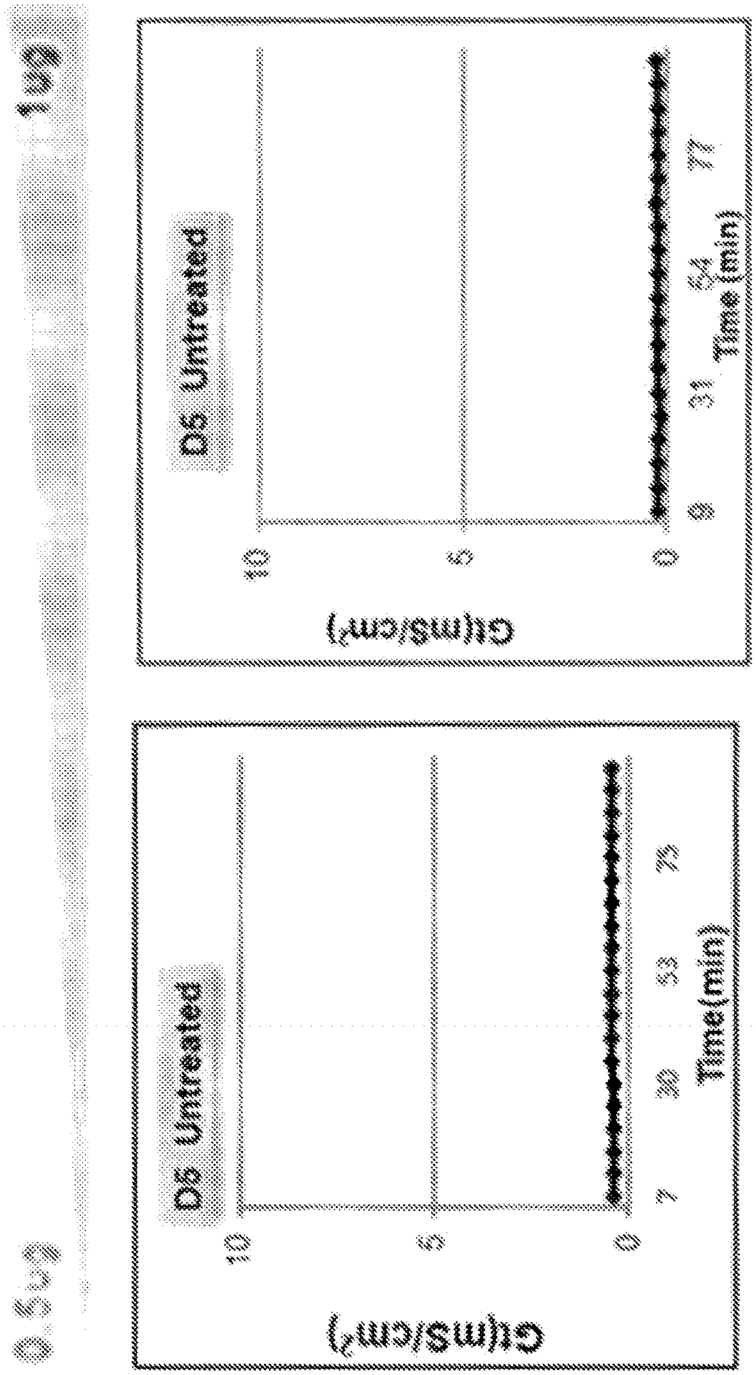
FIG. 9 shows ion channel conductivity measurements (Gt values) in FRT cells transfected with different mRNAs and negative controls as described in Example 10.
Figure 10:
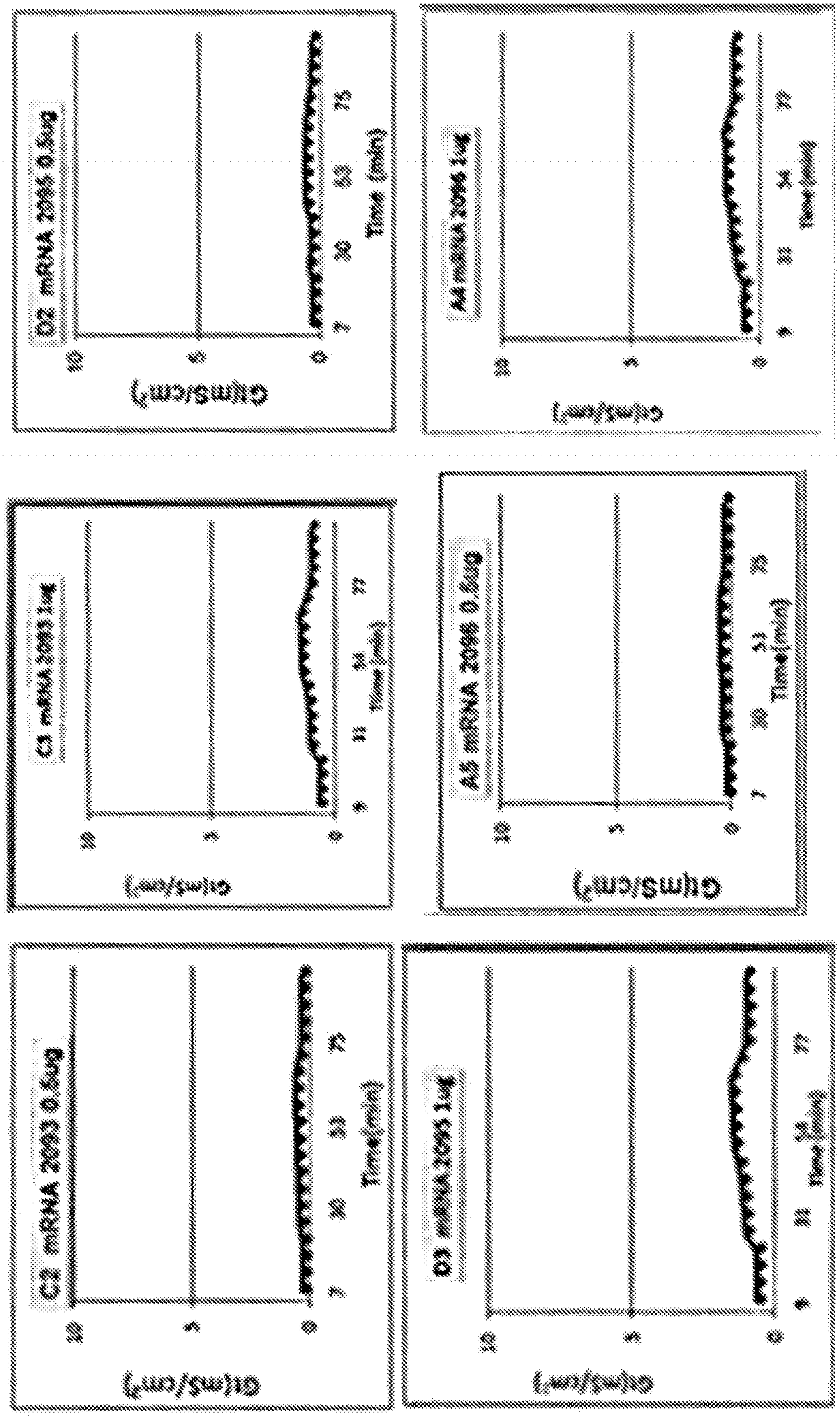
FIG. 10 shows ion channel conductivity measurements (Gt values) in FRT cells transfected with different mRNAs and negative controls as described in Example 10.
Figure 11:
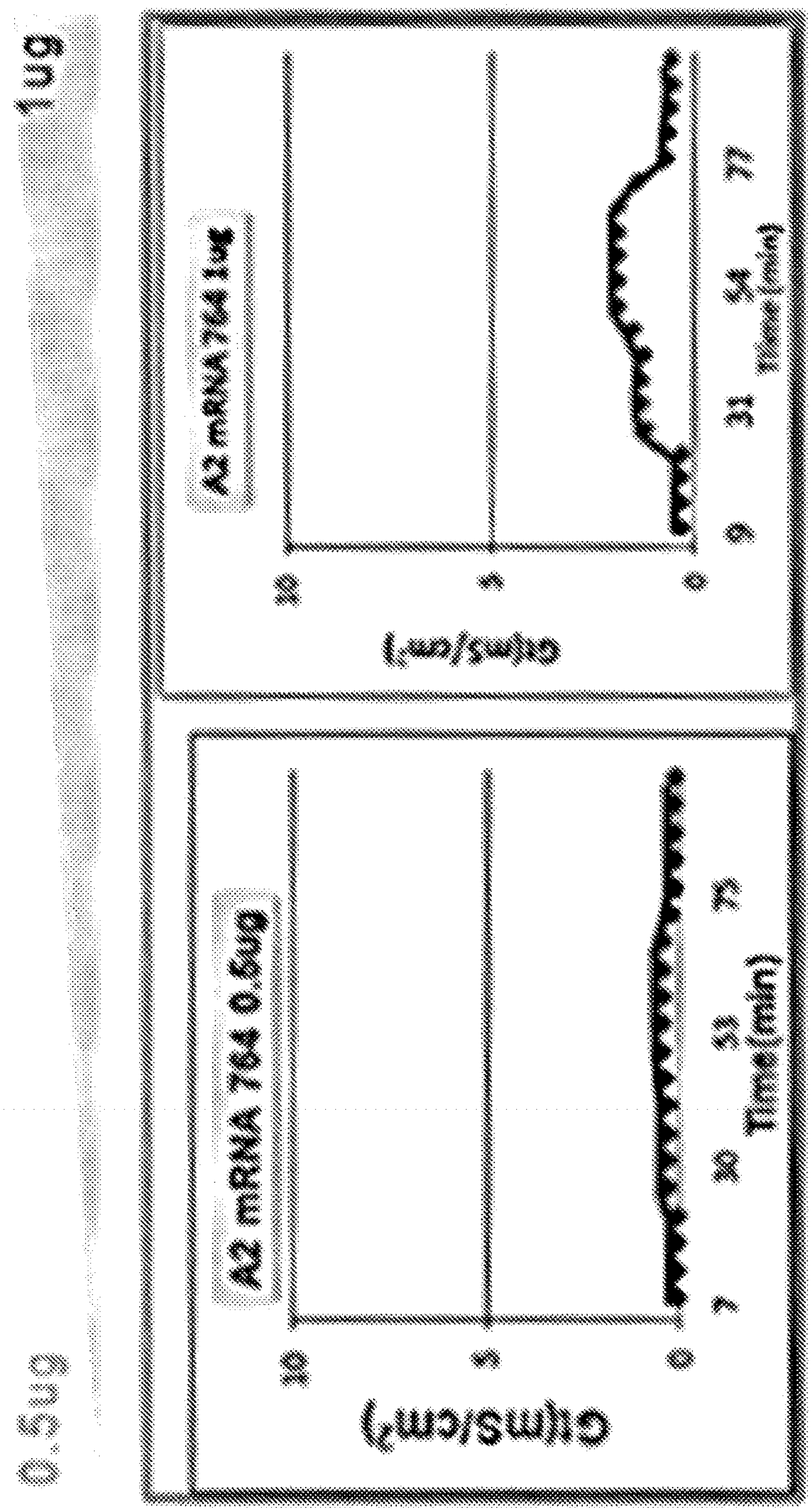
FIG. 11 shows ion channel conductivity measurements (Gt values) in FRT cells transfected with different mRNAs and negative controls as described in Example 10.
Figure 12:
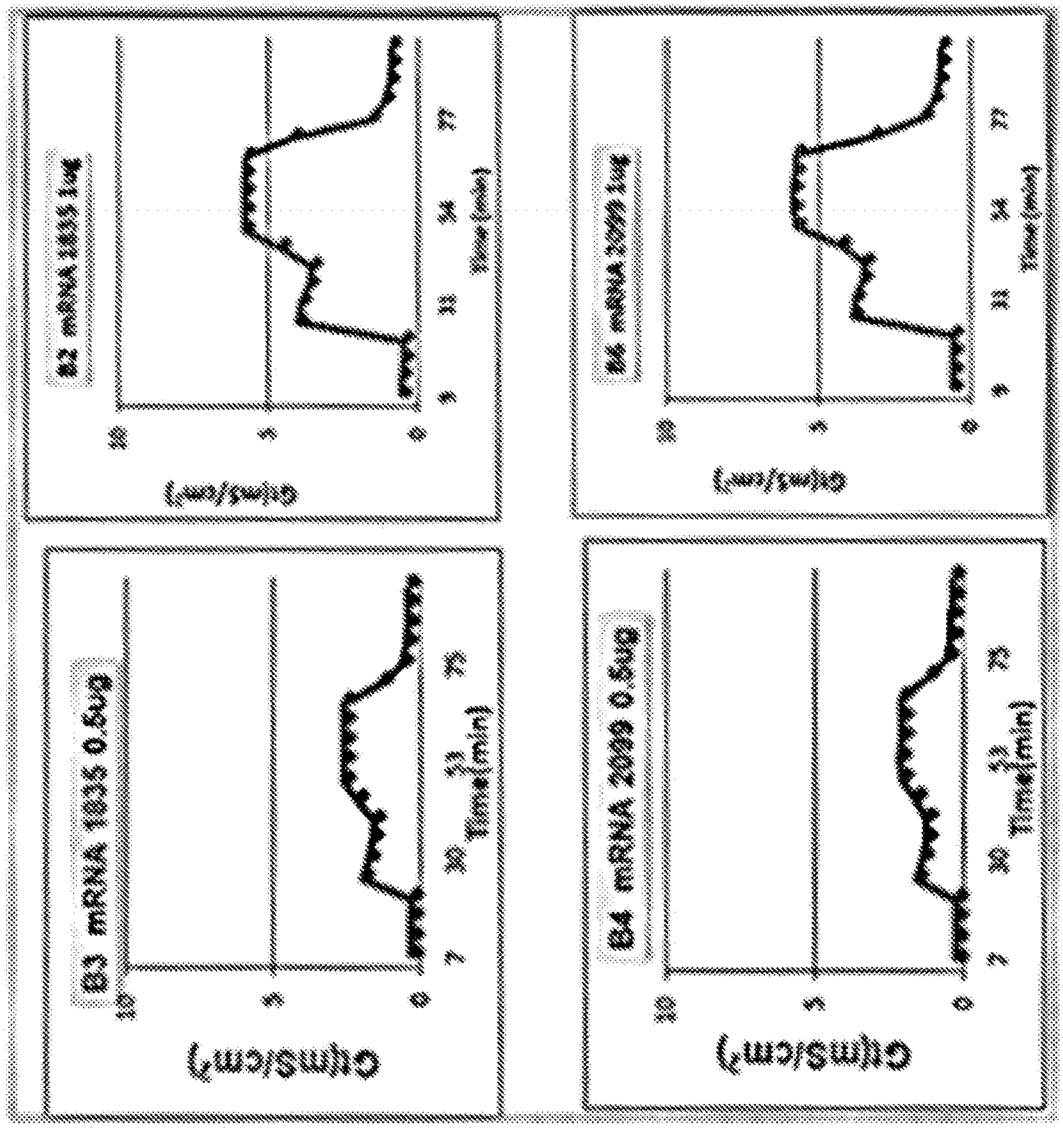
FIG. 12 shows ion channel conductivity measurements (Gt values) in FRT cells transfected with different mRNAs and negative controls as described in Example 10.

The results of these studies are shown in FIGS. 9 through 12. FIG. 9 shows the results for two untreated cells with Gt values being non-existent or near zero at all stages of the process. FIG. 10 shows the results for codon-optimized hCFTR mRNA constructs 2093, 2095, and 2096, which showed some Gt values upon activation (Low Gt responders), but still relatively low activity compared to the reference sequence values shown in FIG. 11 with a Gt value of about 2 for the 1 μg dose. Finally, FIG. 12 shows that the constructs 2099.1 (SEQ ID NO: 72) and 1835.1 (SEQ ID NO: 53) had a 3-fold increase in Gt (Gt of about 6) over the reference sequence (Good Gt responders). In addition, it can be observed in FIG. 12 that an initial increase in Gt was seen at a time point of about 25 to 30 minutes, which was associated with the introduction of Forskolin. A second increase in Gt was observed at about 40 minutes, which was associated with the introduction of VX770. Finally, a decline in Gt was observed at about 77 minutes, which was associated with the introduction of Inh-172. These inflection points further indicate that the CFTR proteins were highly active and responsive to conventional CFTR activators and inhibitors.

Example 11: Minimal Immunostimulatory Activity of Lipid-Encapsulated mRNA

To determine the immunogenic effects, if any, of lipid-formulated hCFTR mRNA, several different lipid formulations were prepared with a mRNA construct of the disclosure. The lipid formulations included cholesterol and DSPC helper lipid and varied as to the ionizable cationic lipid, helper lipid, and PEG-lipid used in the formulation. Selected formulations, designated LF-3 (using Lipid #3, PEG550-PE, and DOTMA), LF-5 (using Lipid #3, PEG750-PE, and DOTMA), LF-7 (using Lipid #4), LF-8 (using Lipid #5), and LF-9 (using Lipid #3, DOTMA, and PEG2000-DMG) were used in this study. If not specified, the PEG-lipid was PEG2000-DMG.

Figure 13B:
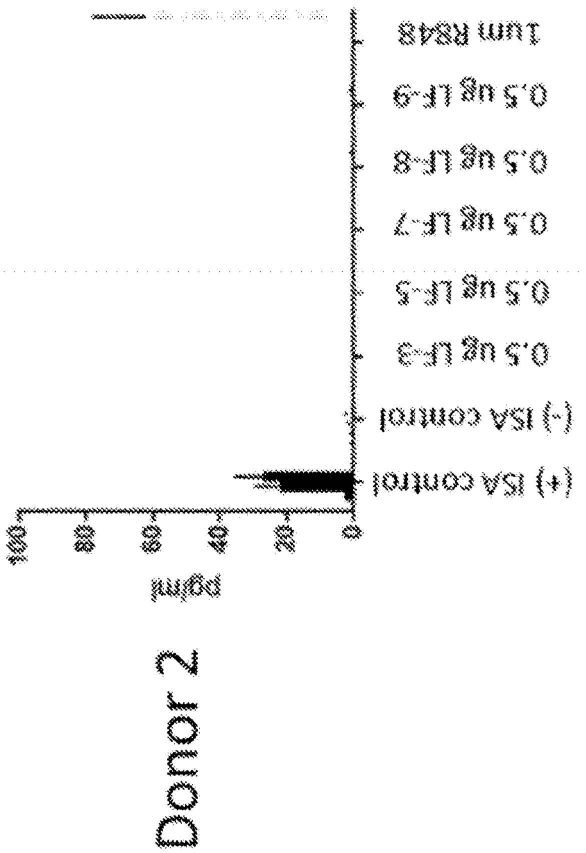
FIGS. 13A-B show IFN-α immunostimulatory levels for selected lipid formulated mRNAs as described in Example 11.
Figure 13A:
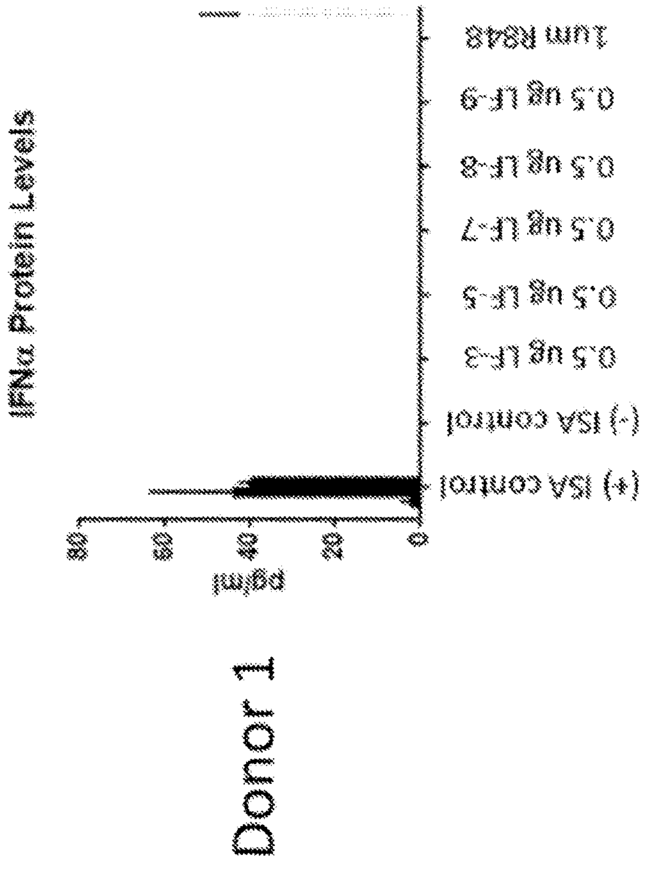
Figure 14B:
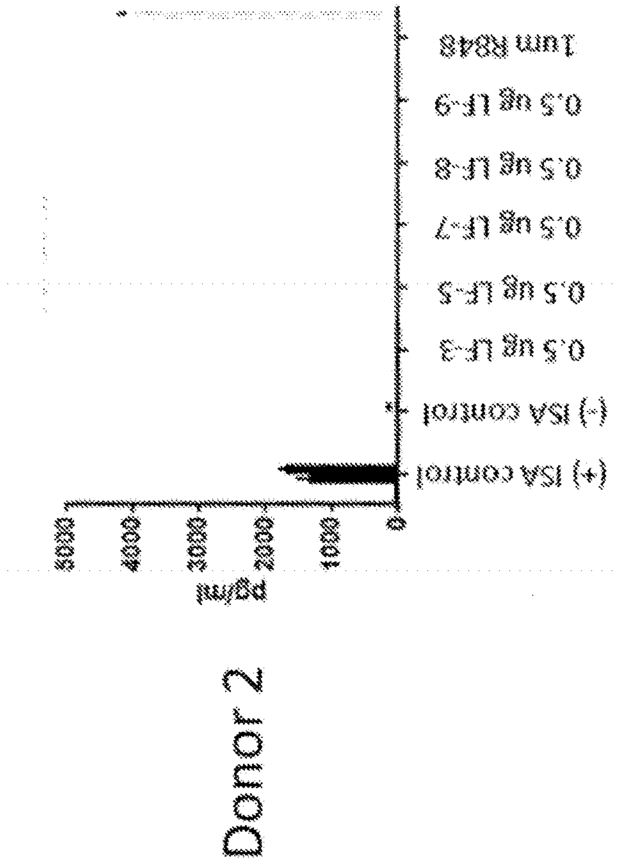
FIGS. 14A-B show IL-6 immunostimulatory levels for selected lipid formulated mRNAs as described in Example 11.
Figure 14A:
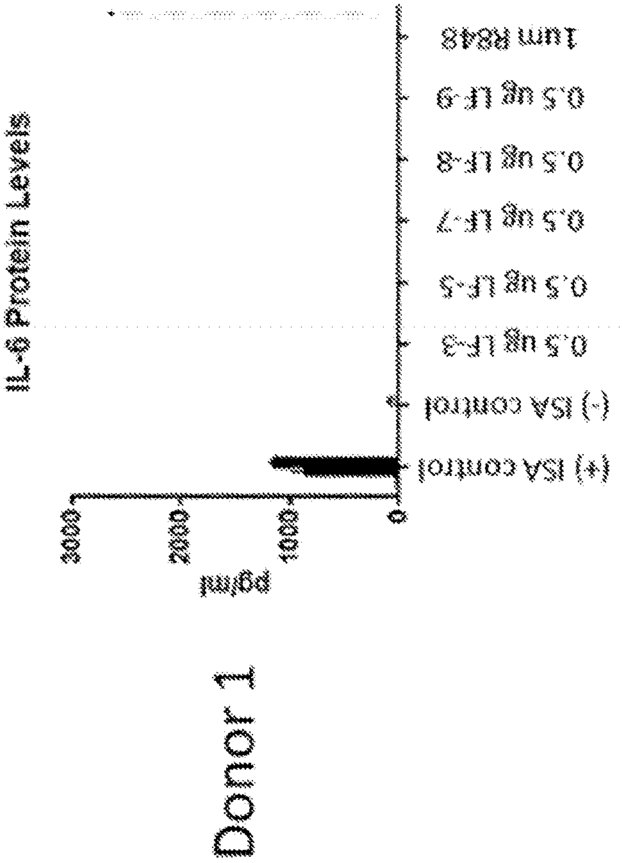
Figure 15A:
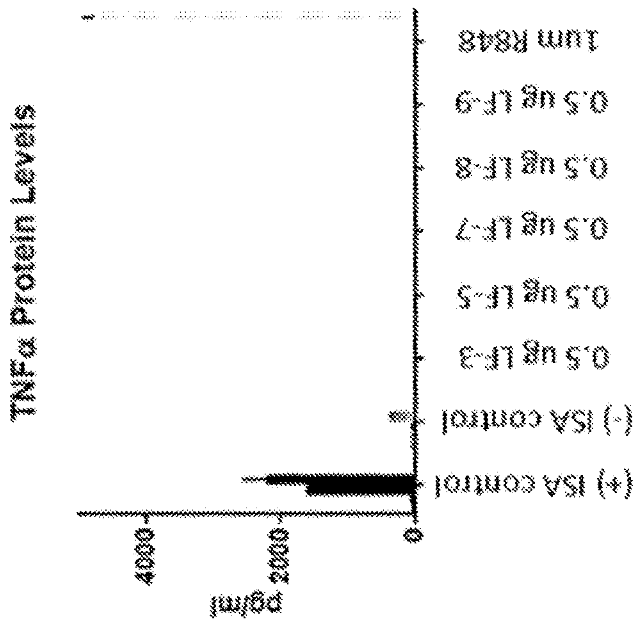
FIGS. 15A-B show TNF-α immunostimulatory levels for selected lipid formulated mRNAs as described in Example 11.
Figure 15B:
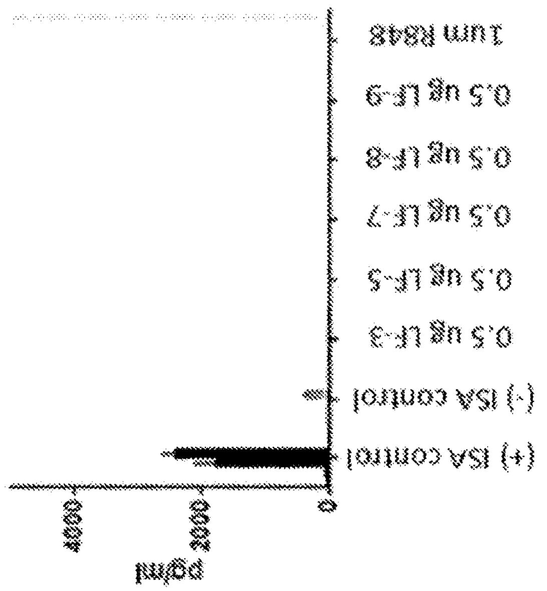

To test for immunogenic effects, fresh peripheral blood mononuclear cells (PBMCs) were isolated from two donors, and the cells were then treated with 0.5 μg of each lipid formulation and incubated at 37° C. In addition, a positive immunostimulatory assay ((+) ISA) control, a negative immunostimulatory assay ((−) ISA) control, and a comparative formulation of Resquimod (R-848), a drug that acts as an immune response activator, were also tested. After 24 hours of treatment, the cells were lysed and supernatants were collected and analyzed for cytokine expression levels. IFN-α measurements are shown in FIGS. 13A and 13B, IL-6 in FIGS. 14A and 14B, and TNF-α in FIGS. 15A and 15B. It can be seen that no detectable levels of IFN-α, IL-6 or TNF-α were observed in human PBMCs following treatment with lipid-formulated hCFTR mRNAs of the present disclosure. However, the (+) ISA and R-848 controls showed appreciable levels of IFN-α, IL-6 or TNF-α. These results indicate that the hCFTR mRNA-lipid formulations described herein have low immunogenicity.

Example 12: Lipid Formulations Shield and Protect the mRNA in CF Sputum

To test the effectiveness of the hCFTR mRNA-lipid formulations of the present disclosure at encapsulating the mRNA and protecting it from degradation, several different lipid formulations were prepared with a mRNA construct of the disclosure. The lipid formulations varied as to the ionizable cationic lipid used in the formulation. Selected formulations, designated LF-1 (using Lipid #1), LF-2 (using Lipid #2), LF-3 (using Lipid #3, PEG550-PE in a lower concentration, and DOTMA), LF-4 (using Lipid #3, PEG550-PE in a higher concentration, and DOTMA), LF-5 (using Lipid #3, PEG750-PE, and DOTMA), LF-6 (using Lipid #3), LF-7 (using Lipid #4), LF-8 (using Lipid #5), and LF-9 (using Lipid #3, DOTMA, and PEG2000-DMG) were used in this study.

Figure 16:
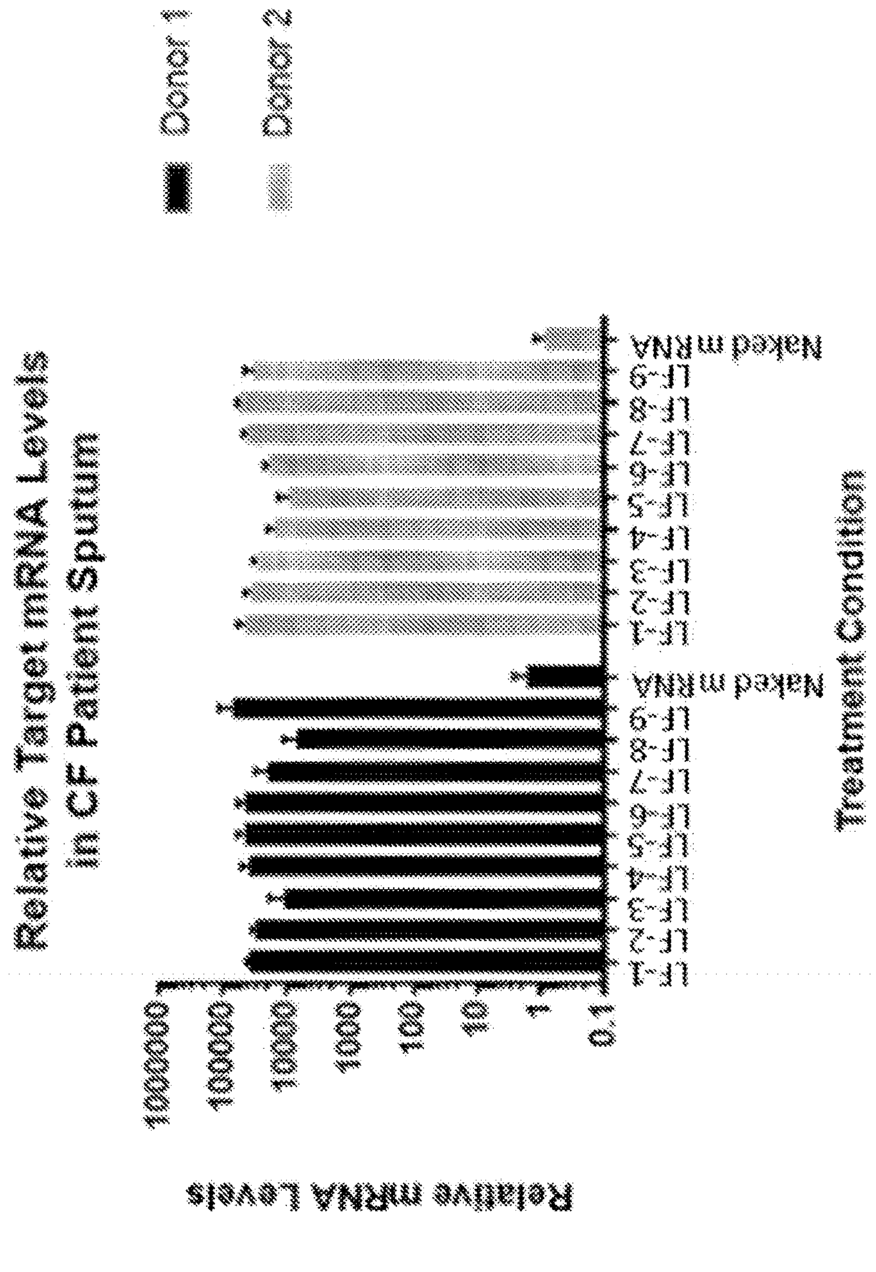
FIG. 16 shows quantitative PCR (qPCR) measurements of mRNA levels in CF sputum for selected hCFTR mRNA-lipid formulations incubated for 24 hours as described in Example 12.

CF sputum from two donor patients were obtained. The hCFTR mRNA-lipid formulations were then tested by combining them with an aliquot of each sputum and incubating each sample for 24 hours. Unformulated mRNA (i.e., naked mRNA) was used as a control. Quantitative PCR (qPCR) was used to assess the relative mRNA levels. The results of this quantitation are shown in FIG. 16. As can be seen, all hCFTR mRNA-lipid formulations showed high relative mRNA levels while the unformulated mRNA showed significant degradation. Thus, the hCFTR mRNA-lipid formulations shield and protect the mRNA from degradation.

Example 13: Lipid Formulations are Distributed in Upper and Lower Airways

Figure 17:
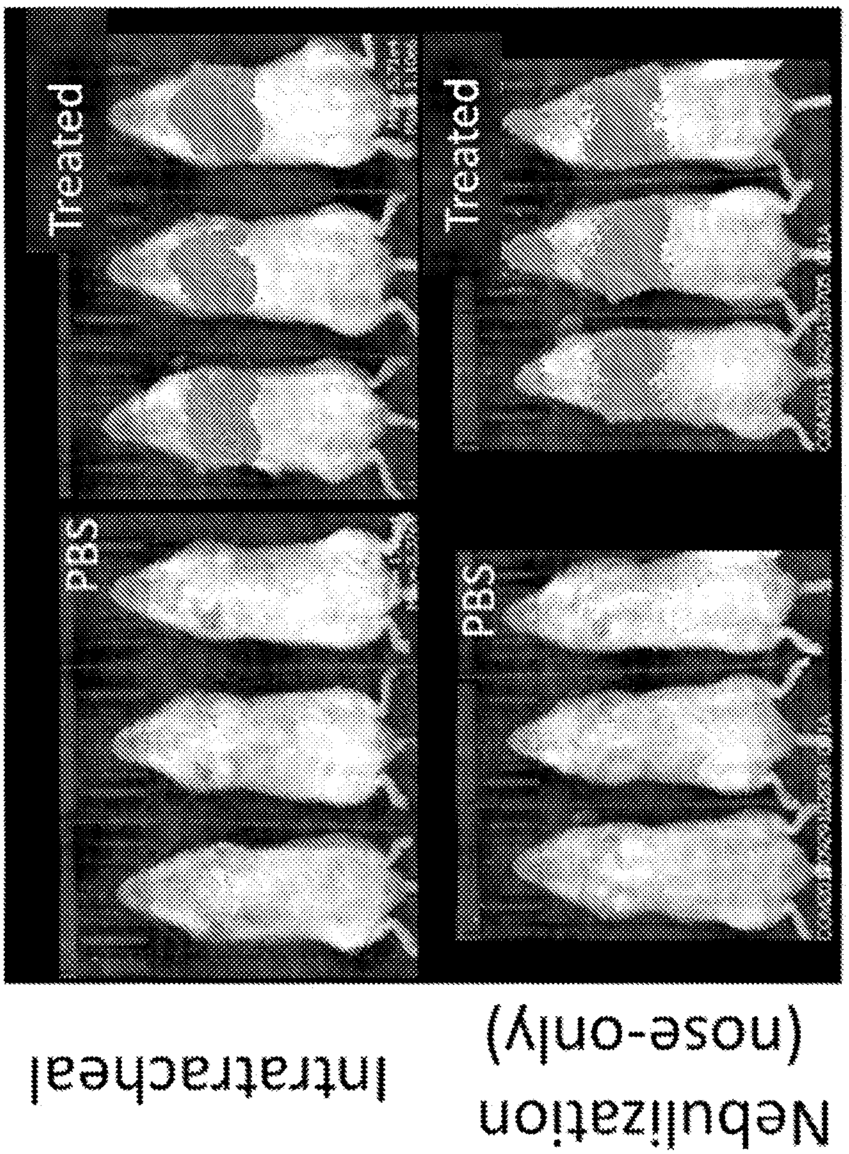
FIG. 17 shows luminescence images for lipid formulated luciferase mRNAs administered to wild-type rats intratracheally (top panel) and via nose-only nebulization (bottom panel) as described in Example 13.

Further studies were conducted to assess efficacy of different administration routes on the expression of mRNA-lipid formulations. A nebulizable composition of a luciferase mRNA-lipid formulation prepared as described in Example 1 was developed by combining in a 1:1 volume ratio with water for injection (WFI). A dose of 0.1 mg of luciferase mRNA/kg was administered intratracheally via a bolus delivered by syringe and a dose of 0.2 mg of luciferase mRNA/kg was administered via nose-only nebulization in wild-type rats. After 6 hours, the rats were injected with luciferin to induce luminescence via luciferase catalysis and luminescence images were acquired using an in vivo imaging system (IVIS®, Perkin Elmer). Phosphate buffered saline (PBS) was used as a negative control for both administration routes. The acquired images are provided in FIG. 17. It can be seen that the intratracheally-treated group displayed in the top panel showed luminescence in the lung, whereas the nose-only nebulization group displayed in the bottom panel showed luminescence in both the nose and lung systems. The PBS controls did not show any luminescence. These results indicate that the mRNA-lipid formulations of the disclosure are able to effectively transfect both nose and lung-tissue systems, which represent the upper and lower airways.

Figure 18:
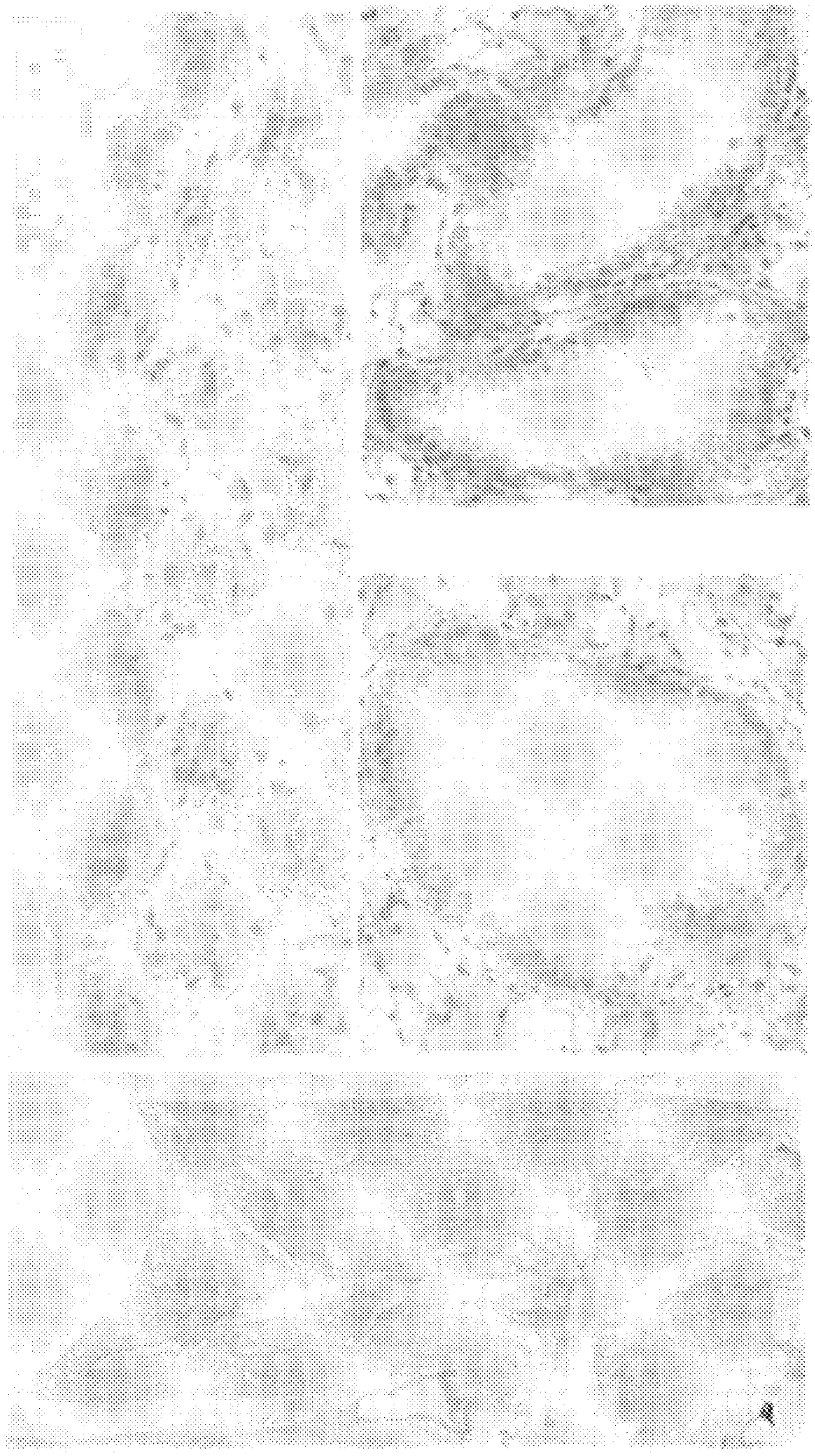
FIG. 18 shows eGFP immunohistochemistry images for PBS controls as a comparison against lipid formulated eGFP mRNA treated animals as described in Example 14.
Figure 19:
FIG. 19 shows eGFP immunohistochemistry images for lipid formulated eGFP mRNA treated animals as described in Example 14.

Example 14: Lipid Formulations Delivered a Reporter mRNA into Wild-Type Murine Lung Epithelial Airways To determine whether lipid-formulated mRNAs delivered to the airways effectively transfect lung epithelial cells in vivo, an enhanced green fluorescent protein (eGFP) reporter mRNA was formulated into a lipid formulation according to the method described in Example 1. Wild-type mice were dosed intratracheally via a bolus delivered by syringe with 0.4 mg/kg of an optimized eGFP mRNA-lipid formulation and a negative control of PBS. The mice were then euthanized 24 hours later, and their lungs were extracted and processed for histology. The lung samples were treated with an eGFP-specific antibody and confocal fluorescence microscopy images were taken. FIG. 18 shows images for the negative PBS controls. It can be seen that no fluorescence was detected throughout the tissue. In contrast, images for the eGFP mRNA-treated mice shown in FIG. 19 displayed immunostaining in both the large and small airways. Thus, the mRNA-lipid formulations effectively transfected lung epithelial cells.

Example 15: Lipid Formulations Efficiently Deliver the Cargo mRNA in the Epithelial Airways of a Transgenic Mouse Model To further test whether the mRNA-lipid formulations can efficiently deliver mRNA to lung epithelial cells, a TdTomato fluorescent experiment was designed and conducted. In this experiment, transgenic floxed TdTomato mice were used. These mice were engineered to have a gene encoding TdTomato fluorescent reporter protein that also includes a CRE-based stop cassette (i.e., floxed cassette), which prevents complete transcription of the TdTomato gene in the absence of CRE recombinase (CRE). The floxed TdTomato mice are deficient in the CRE gene.

Figure 20:
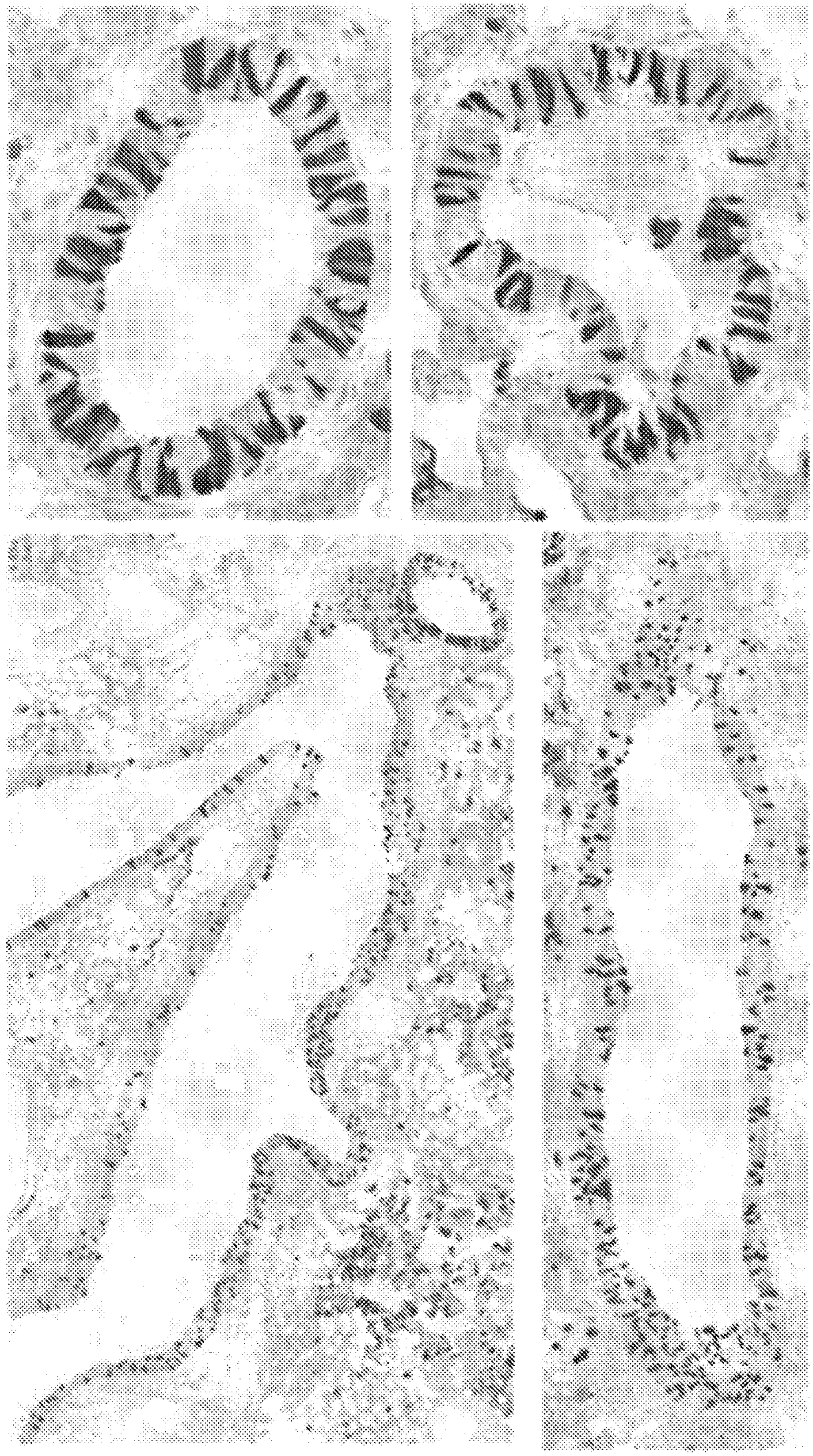
FIG. 20 shows TdTomato (TdT) fluorescence imaging for lung samples derived from transgenic floxed-TdTomato mice after administration of a CRE mRNA-lipid formulation as described in Example 15.

The floxed TdTomato mice were dosed intratracheally at 1 mg/kg with an optimized CRE mRNA-lipid formulation prepared according to the method described in Example 1. The mice were euthanized 72 hours later to allow full recombination of the floxed cassette by the CRE protein. Then, the lungs were extracted and processed for immunohistochemistry. The lung samples were treated with a TdTomato-specific antibody, and confocal immunofluorescence microscopy was used to collect images of the samples. FIG. 20 shows the image for mice treated with CRE mRNA-lipid formulations, which were able to generate a CRE protein that excised out the floxed cassette, allowing the expression of the TdTomato protein. TdTomato immunostaining was present in epithelial cells throughout large and small airways, thus indicating that the CRE mRNA-lipid formulations efficiently delivered the mRNA cargo to lung epithelial cells of both the large and small airways.

Example 16: Lipid Formulations Target Ciliated Epithelial Cells

A further experiment was designed and conducted to test whether the mRNA-lipid formulations were specifically targeting only lung epithelial cells. In this experiment, the Floxed-TdTomato transgenic mice approach described in Example 15 was used, and the main cellular populations expressing the TdTomato protein were profiled. Briefly, 1 mg/kg of mRNA-lipid formulation was delivered intratracheally to airways of Cre/LoxP mice. Upon Cre recombination, cells express the TdTomato protein that can be visualized by immunohistochemistry using an anti-TdTomato antibody. Co-localization of TdTomato with FoxJ1, a marker for ciliated epithelial cells, was analyzed by staining samples with an anti-FoxJ1 antibody. DAPI was used as a general counterstain for cellular nuclei to show all cells, including cells that were not ciliated and did not express the CRE protein.

Figure 21:
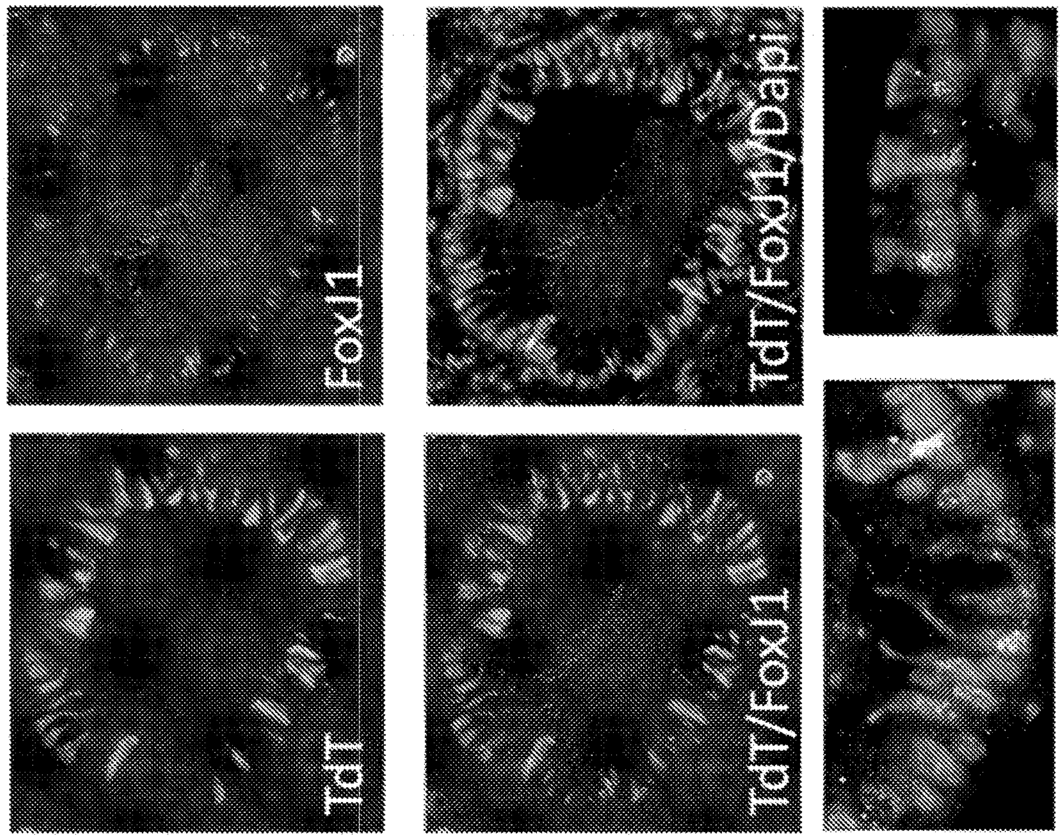
FIG. 21 shows fluorescence imaging for lung samples derived from floxed-TdTomato mice after administration of a CRE mRNA-lipid formulation and further processed with FoxJ1 and DAPI stains as described in Example 16. High magnifications of co-localization of TdT and FoxJ1 are shown in the bottom panel.

Samples were treated with a specific FoxJ1 antibody, and fluorescence imaging was conducted. The captured images are shown in FIG. 21. The first image labeled TdT is a sample that was not treated with FoxJ1 or DAPI, but represents a lung sample from floxed TdTomato mice treated with a CRE mRNA-lipid formulation. It can be seen that this image shows fluorescence only at the epithelial layer. The second image, labeled FoxJ1, represents a sample treated with only the FoxJ1 stain and processed for immunofluorescence. This images specifically highlights ciliated epithelial cells. The third image, labeled TdT/FoxJ1, represents a lung sample taken from floxed TdTomato mice treated with CRE mRNA-lipid formulation and stained with anti-FoxJ1 antibody. It can be seen that the fluorescence due to TdTomato and FoxJ1 are colocalized at the lung epithelium, thus confirming that TdTomato was indeed associated with lung epithelial cells. Finally, the fourth image, labeled TdT/FoxJ1/DAPI, represents a lung sample taken from floxed TdTomato mice treated with CRE mRNA-lipid formulation, followed by sample staining with anti-FoxJ1 antibody and DAPI. This image shows the colocalization of TdTomato and FoxJ1; however cells peripheral to the FoxJ1/TdTomato-positive cells only stained with DAPI. This indicates that the CRE mRNA-lipid formulation specifically targeted the lung epithelial cells, and did not transfect deeper layers of cells. Further images of TdT/FoxJ1 colocalization at high magnification are shown in the bottom panel in FIG. 21.

These results show that lipid-formulated mRNA is efficiently delivered to ciliated epithelial cells in rodents.

Figure 22:
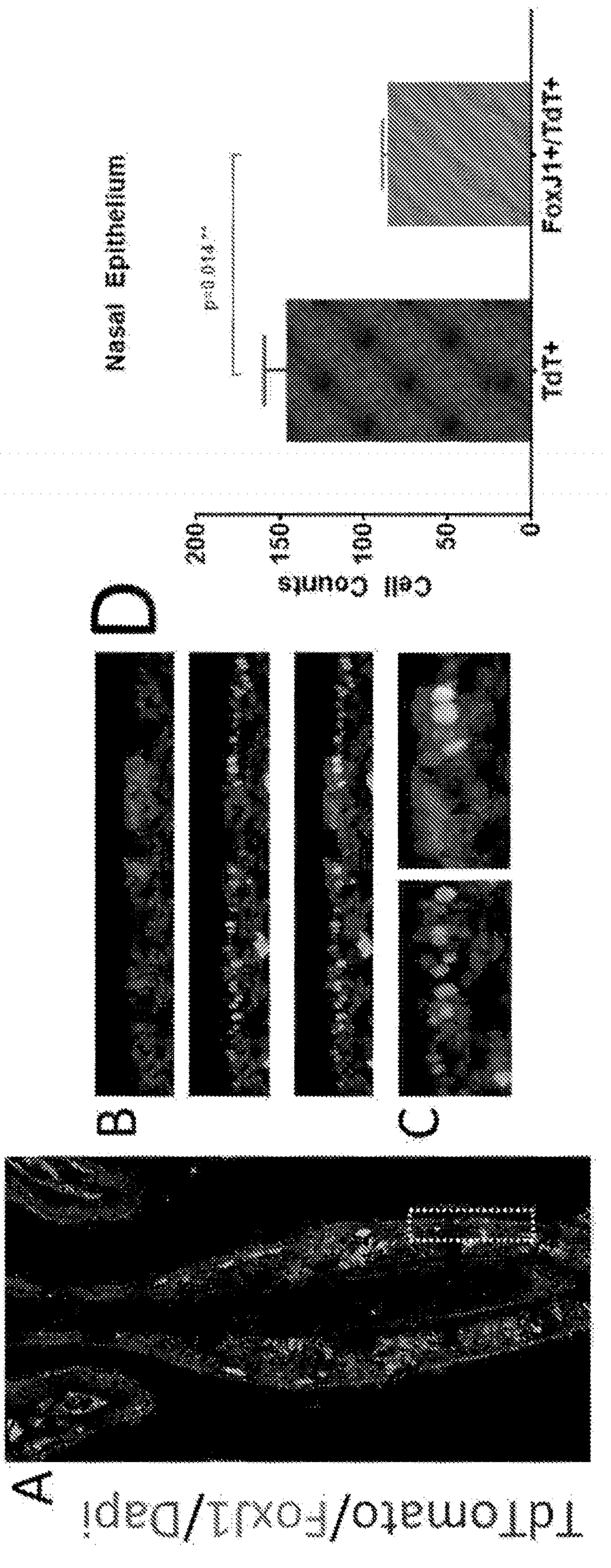
FIG. 22, in panels A-D, shows cellular profiling of the nasal epithelia by fluorescence imaging for samples derived from floxed-TdTomato mice after administration of a CRE mRNA-lipid formulation and further processed with FoxJ1 and DAPI stains as described in Example 17.

Example 17: Cellular Profiling of the Nasal Epithelia Indicates that Lipid Formulations are Taken Up by Ciliated Epithelial Cells To test uptake in nasal epithelial cells, the floxed-TdTomato mice protocol described in Examples 16 was also used to conduct co-localization experiments with TdTomato and FoxJ1 in mice treated with different CRE mRNA-lipid formulations. The formulations were delivered intranasally by droplet deposition. After 72 hours, the mice were euthanized, and the nasal portion of the head underwent a decalcification process to remove the bone but keep the structure of the nasal epithelia intact. When completed, the nasal epithelial tissue samples were processed for immunofluorescence following the procedures described in Example 16. In these experiments, TdTomato fluorescence is indicative of cells targeted by the CRE mRNA-lipid formulations, and FoxJ1 is indicative of ciliated cells in the nasal epithelia. DAPI was used as a counterstain of cellular nuclei to show cells that were not ciliated and not transfected with CRE mRNA. The resulting confocal fluorescence microscopy images are shown in FIG. 22. The images shown in Panel A provide a panoramic view of the nasal septa. Panels B and C provide high magnification images of the area indicated by the dashed rectangle in Panel A. In agreement with the lung studies of Example 16, colocalization of FoxJ1 and TdTomato was observed, indicating successful transfection of ciliated epithelial cells in the nasal epithelium, while only DAPI was observed in other cells. Panel D provides a quantitative plot of cell counts for all cells expressing TdTomato (TdT+) as well as cells expressing both TdTomato and FoxJ1 (FoxJ1+/TdT+). The results indicate that 60% of the cells that took up lipid-formulated CRE mRNA were ciliated cells. Thus, CRE mRNA-lipid formulations showed high selectivity toward ciliated epithelial cells of the nasal epithelia.

Figure 23:
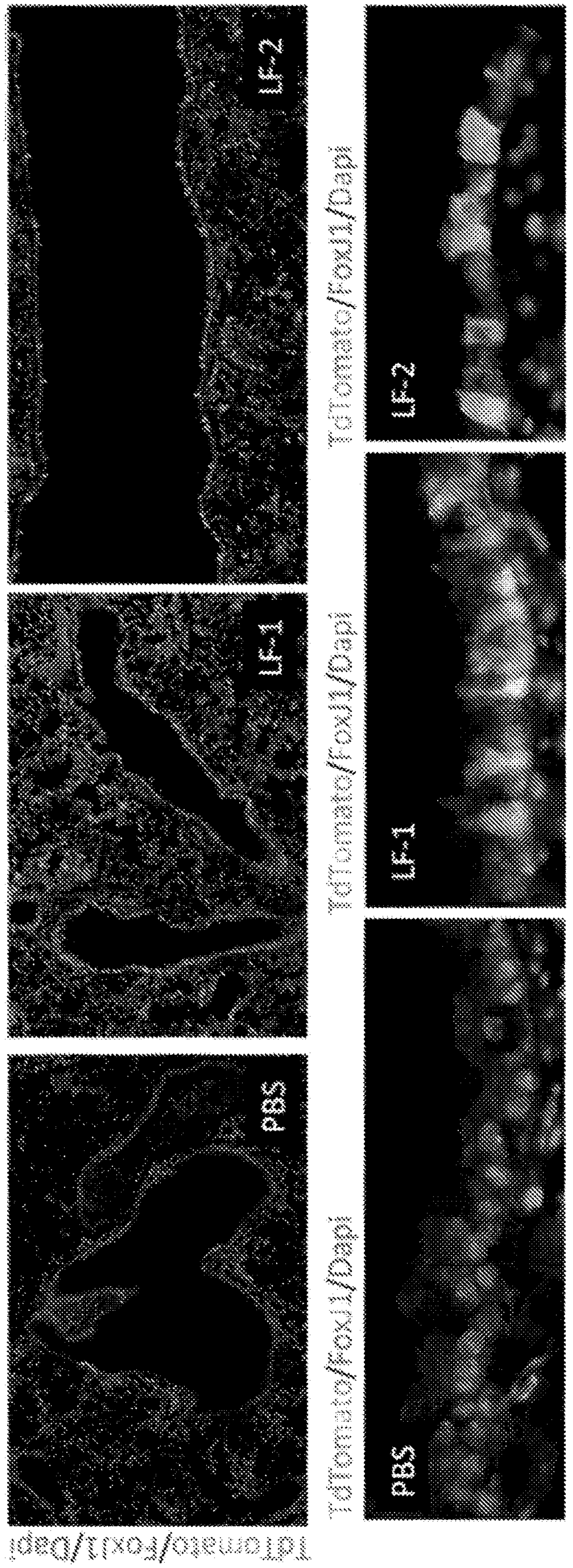
FIG. 23 shows fluorescence imaging for lung samples derived from floxed-TdTomato mice after administration of selected CRE mRNA-lipid formulations and further processed with FoxJ1 and DAPI stains as described in Example 18.

Example 18: Different Lipid Formulations can Efficiently Target the Murine Epithelial Airways The floxed-TdTomato mice experiments described in Example 16 were repeated to test co-localization of TdTomato and FoxJ1 in mice treated with different CRE-mRNA-lipid formulations (LF-1 and LF-2 as described in Example 12). A further negative control of PBS was also used. The results are shown in FIG. 23, which shows that both the LF-1 and LF-2 formulations were able to express the CRE protein, thereby allowing expression of TdTomato, which co-localized with the FoxJ1 marker. The PBS-treated samples did not show any fluorescence. Thus, the different formulations both resulted in highly specific expression in the lung epithelial cells.

Figure 24:
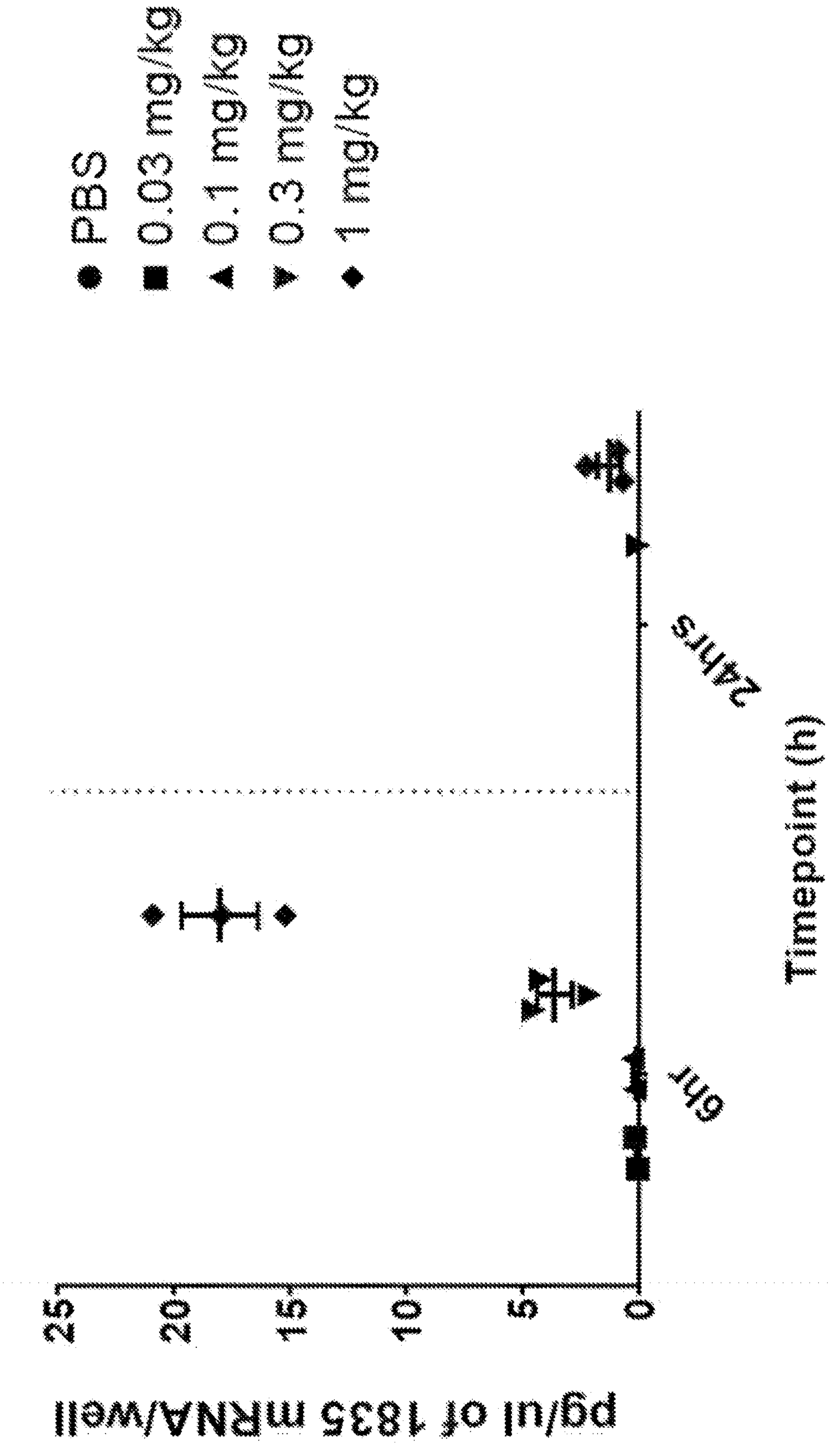
FIG. 24 shows the mRNA levels over time quantified by Quantigene® Assay for CFTR knockout (KO) mice treated intratracheally with different dose levels of lipid formulated-hCFTR mRNA as described in Example 19.
Figure 25:
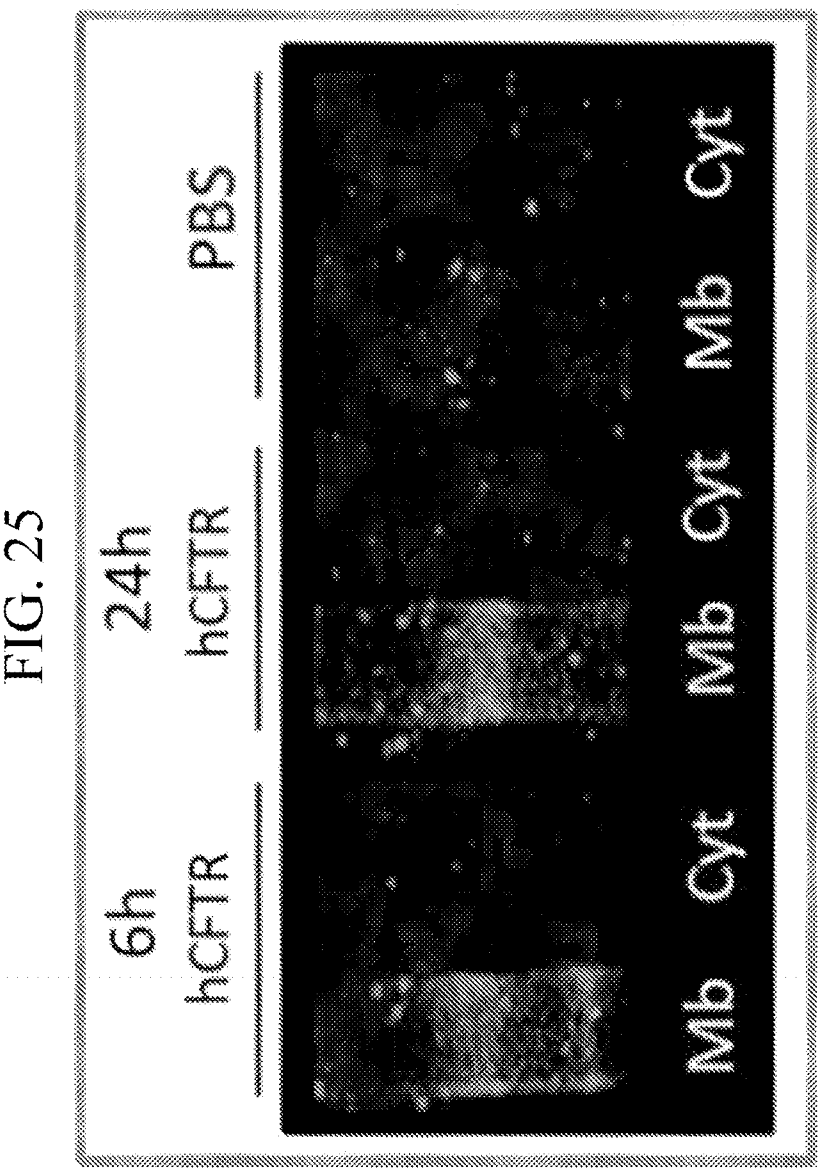
FIG. 25 shows hCFTR protein levels in membrane (Mb) and cytosolic (Cyt) fractions analyzed by WB using an antibody specific for hCFTR for CFTR knockout (KO) mice treated intratracheally with different dose levels of lipid formulated-hCFTR mRNA as described in Example 20.

Example 19: mRNA Kinetics in Mice Treated Intratracheally with hCFTR mRNA-Lipid Formulations To study the rate of mRNA expression for hCFTR mRNA-lipid formulations, a formulation was prepared as described in Example 1 for in vivo monitoring experiments, using the 1835.1 construct (SEQ ID NO: 53). In these experiments, CFTR knockout (KO) mice (i.e., mice deficient in the CFTR gene) were dosed intratracheally via a bolus delivered by syringe at dose levels of 0.03, 0.1, 0.3 and 1 mg/kg of the hCFTR mRNA-lipid formulation. Additional mice were treated with the negative control of PBS. The mice were then euthanized at 6 hours or 24 hours, their lungs were extracted, and mRNA levels were quantified using the Quantigene® Assay. The results of the assay are shown in FIG. 24. At the 6-hour timepoint, increasing levels of mRNA were seen for increasing doses, but baseline levels of mRNA were reached by 24 hours. Thus, almost all of the mRNA was consumed within 24 hours of administration. Example 20: hCFTR Protein Levels are Detected in Mice Using a Protein Enrichment Protocol To further study the degree of protein expression of hCFTR mRNA-lipid formulations, samples derived from the experiments of Example 19 were first fractionated using standard protocols, and membrane and cytosolic fractions were generated. To characterize the hCFTR protein in membrane and cytosolic fractions, the fractions were analyzed by WB using an antibody specific for hCFTR according to the protocol described in Example 1. The results for the WB assays can be seen in FIG. 25. It can be seen that for the mice euthanized at the 6-hour timepoint, both C- and B-bands were observed at 170 kDa and 150 kDa, respectively. However, at 24 hours, only the C-band was observed at the expected size of 170 kDa. In addition, hCFTR bands were only observed in the enriched membrane fractions (labeled as Mb) and were not present in the cytosolic fractions (labeled as Cyt) or for the negative control of PBS. These results are in agreement with those of Example 18, showing that at 6 hours, mRNA expression was still ongoing in the cell, while by 24 hours, expression had been completed as seen by the presence of only the C-band corresponding to fully mature, glycosylated hCFTR, but not the B-band. In addition, these results indicate that hCFTR was expressed and properly localized in the cellular membrane.

Example 21: mRNA Kinetics in Aerosolized hCFTR mRNA-Lipid Formulation

Figure 26:
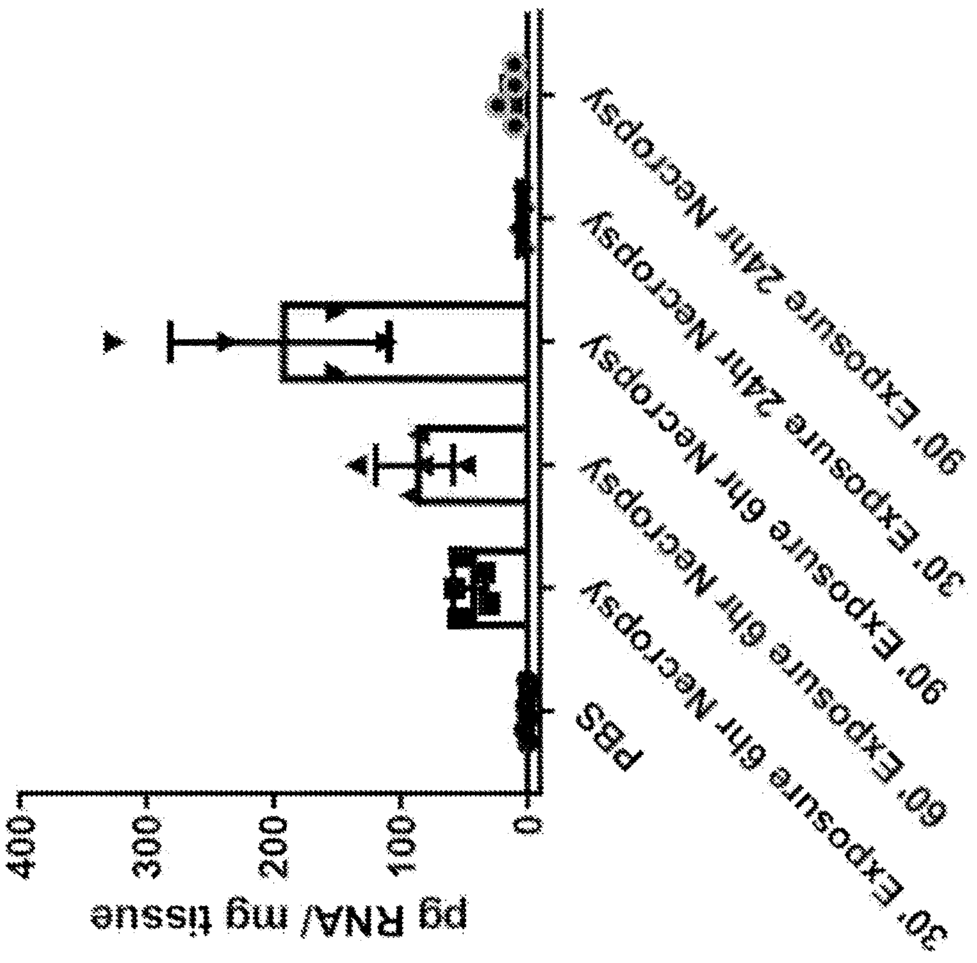
FIG. 26 shows hCFTR mRNA levels quantified by Quantigene® Assay in samples derived from rats after 6 hours or 24 hours post-exposure for different exposure time lengths as described in Example 21.

The effect of exposure time on hCFTR mRNA expression was also studied. A formulation was prepared as described in Example 1 for in vivo monitoring experiments using the 1835.1 construct (SEQ ID NO: 53), and wild-type rats were treated using a nose-only nebulization system. The rats were exposed to the formulation for 30, 60 or 90 minutes. The rats were then euthanized at either 6 hours or 24 hours post-exposure. Rat lungs were extracted and hCFTR mRNA levels were quantified by Quantigene® Assay. The results are shown in FIG. 26. It can be seen that an increase in exposure time correlated with hCFTR mRNA levels at the 6-hour time point, but by 24 hours post exposure, the mRNA levels reached a baseline level similar to the negative control of PBS. Thus, regardless of exposure time, the mRNA was completely consumed by 24 hours, while increased exposure duration resulted in increased mRNA uptake.

Figure 27:
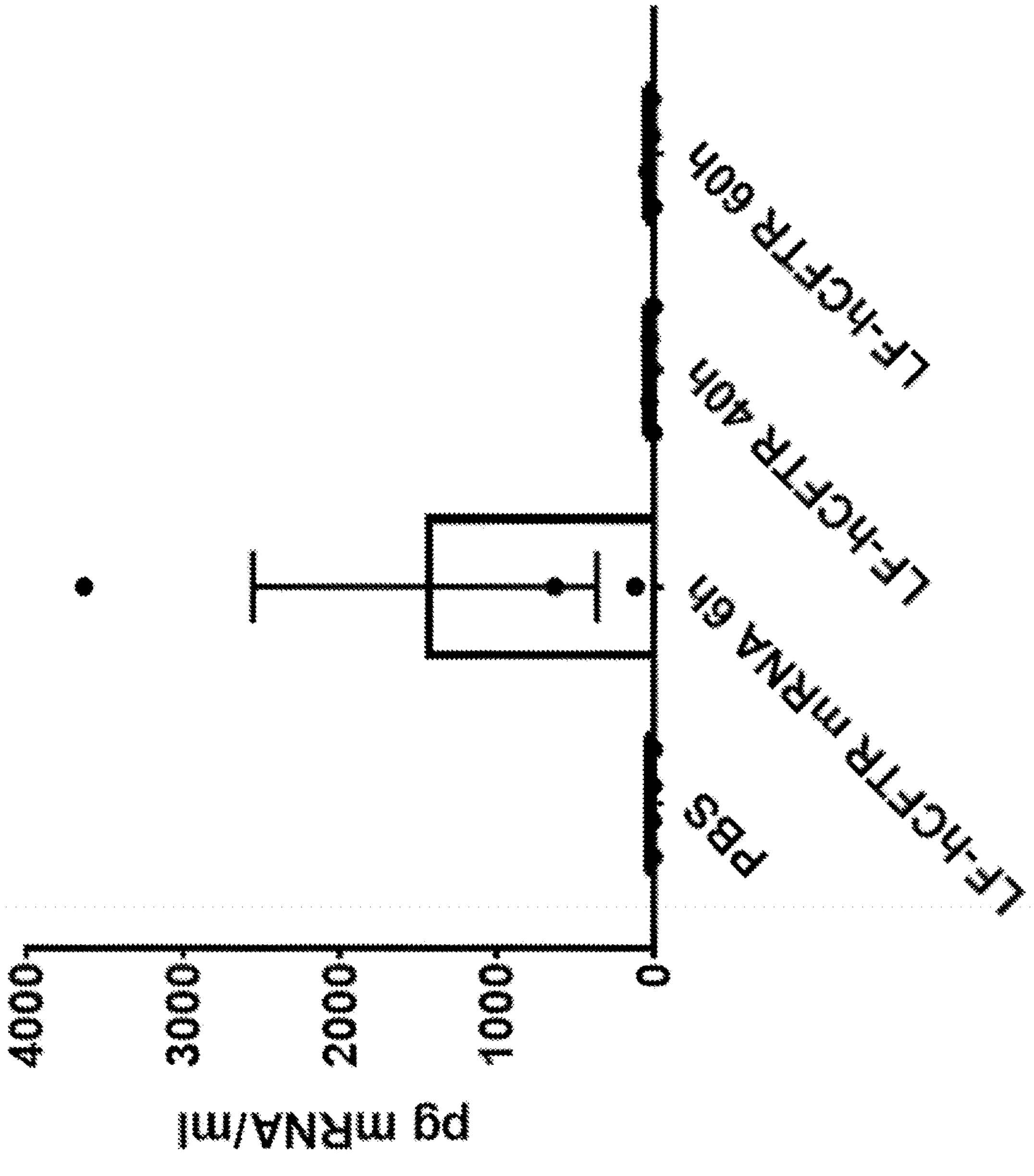
FIG. 27 shows hCFTR mRNA levels quantified by Quantigene® Assay on nasal epithelium samples of CFTR KO mice treated with lipid formulated-hCFTR mRNA at 6 hours, 40 hours, and 60 hours post last-dose as described in Example 22.

Example 22: Analysis of Nasal Epithelium Samples of CFTR KO Mice Treated with hCFTR mRNA-Lipid Formulation Extended time-based studies were conducted to further assess the kinetics of hCFTR mRNA delivery in vivo. CFTR KO mice were treated intranasally via a bolus delivered by syringe with a hCFTR mRNA-lipid formulation prepared as described in Example 1 using the 1835.1 construct (SEQ ID NO: 53, formulation LF-1). The mice were treated for two consecutive days with either the lipid formulation or a negative PBS control, receiving 50% of the daily dose in the morning and 50% of the daily dose in the afternoon as the mice could not internalize a full dose volume in a single administration. The mice were euthanized at either 6 hours, 40 hours, or 60 hours after the last dose, and nasal epithelium was extracted and analyzed for hCFTR mRNA content using the Quantigene® assay. The results are shown in FIG. 27. At 6 hours, mRNA levels peaked, and then mRNA levels reached baseline levels at 40-60 hours. These results indicate kinetics of mRNA consistent with consumption of mRNA by 40 hours after the last dose even after multiple doses and extended treatment regimens.

In addition, live mice were evaluated for hCFTR activity at 40 hours and 60 hours after the last dose. Specifically, the chloride channel current was measured by Nasal Potential Difference (NPD) according to standard protocols (Hodges et al., Genesis 46, 546-552, 2008).

Figure 28:
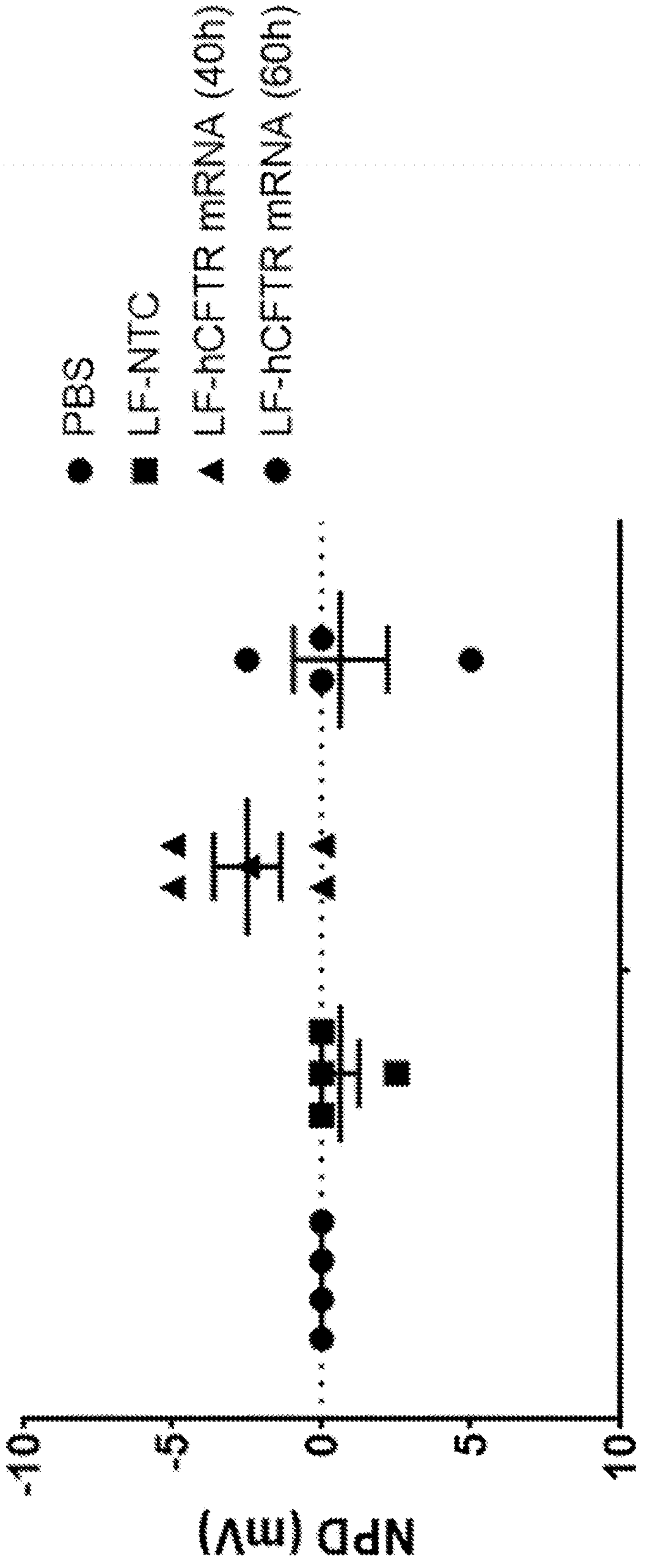
FIG. 28 shows chloride channel current measured by Nasal Potential Difference (NPD) at 40 hours and 60 hours post last-dose in CFTR KO mice treated with a lipid formulated-hCFTR mRNA as described in Example 22.

PBS and anon-targeting control (NTC) lipid formulation were used as negative controls in these experiments. The results of the NPD assay are shown in FIG. 28. At 40 hours, ⅗ of the mice showed increased current measurements and ¼ showed functional activity at 60 hours. These results were consistent with the variability of the NPD assay. In contrast, the negative controls did not show any appreciable activity. These data indicate that the codon-optimized hCFTR mRNAs tested expressed functionally active hCFTR protein in vivo.

Example 23: Nasal Potential Difference Measurements in CFTR KO Mice Treated with Different hCFTR mRNA-Lipid Formulations The experiments of Example 22 were extended to test different hCFTR mRNA-lipid formulations. In this experiment, CFTR KO mice were treated intranasally with the hCFTR mRNA-lipid formulations for two consecutive days as described in Example 22. The specific hCFTR mRNA-lipid formulations used were prepared as described in Example 1, using construct numbers 1835.1 (SEQ ID NO: 53), 2099.1 (SEQ ID NO: 72), and the reference sequence construct number 764.1 (SEQ ID NO: 47). Additionally, PBS was used as a negative control. At 40 hours after the last dose, the chloride channel current was measured by NPD according to standard protocols (Hodges et al., Genesis 46, 546-552, 2008).

Figure 29:
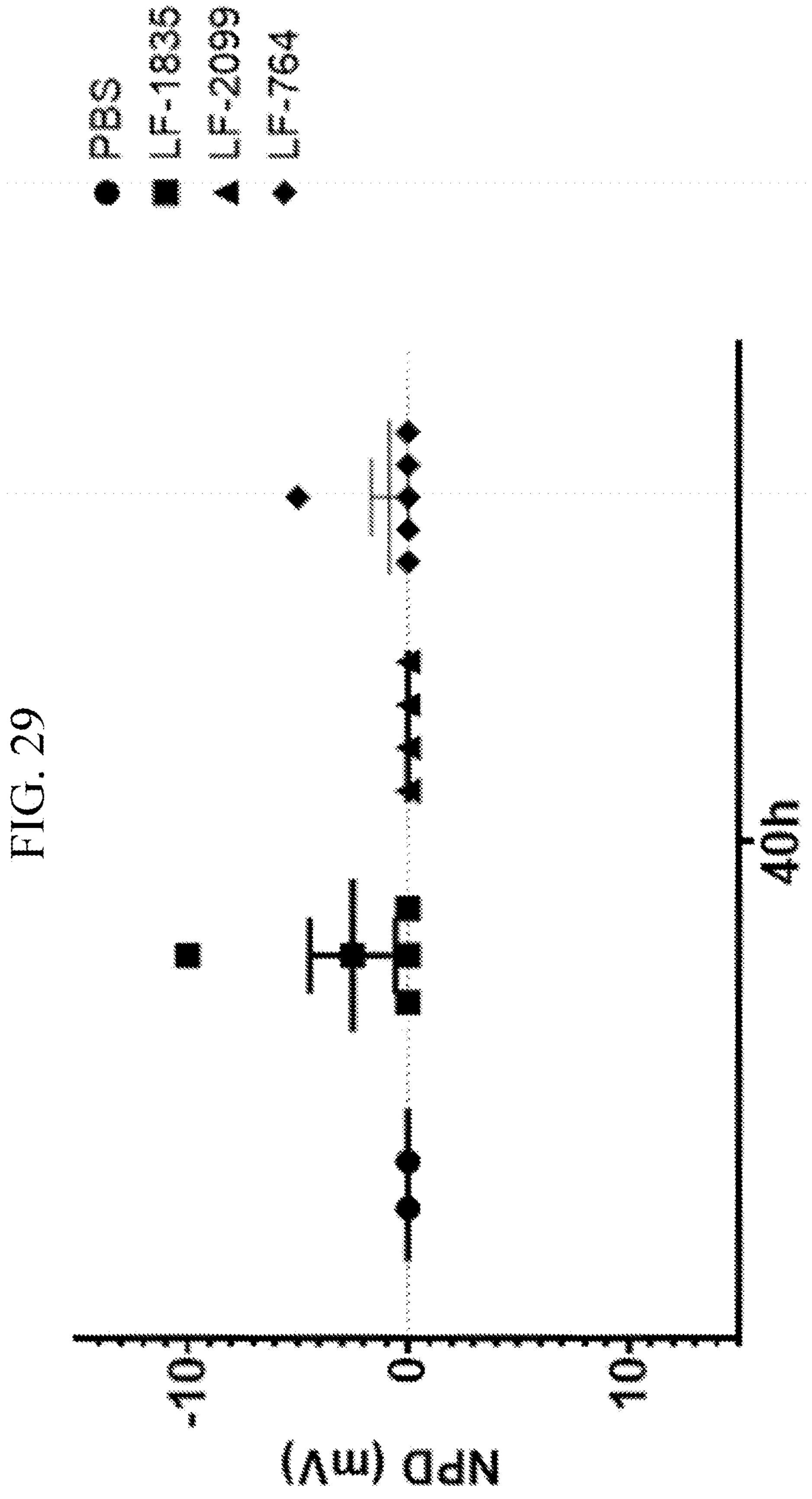
FIG. 29 shows chloride channel current measured by Nasal Potential Difference at 40 hours and 60 hours post last-dose in CFTR KO mice treated with different hCFTR mRNA-lipid formulations as described in Example 23.

The results of the NPD assay are provided in FIG. 29. At 40 hours, the lipid formulation that included a construct of SEQ ID NO: 53 showed increased current in ⅖ of the mice. No current was observed for the lipid formulation that included a construct of SEQ ID NO: 72, and ⅙ of the mice were observed to have an increased current with the lipid formulation that included a construct of SEQ ID NO: 47. These results were consistent with the variability of the NPD assay. These data confirmed that the hCFTR mRNA having a sequence of SEQ ID NO: 53 expressed functionally active hCFTR protein in vivo and showed superior activity as compared to the negative control and the reference sequence.

Example 24: Aerosolized Lipid Particles Generate a Breathable Droplet Size

Figure 30:
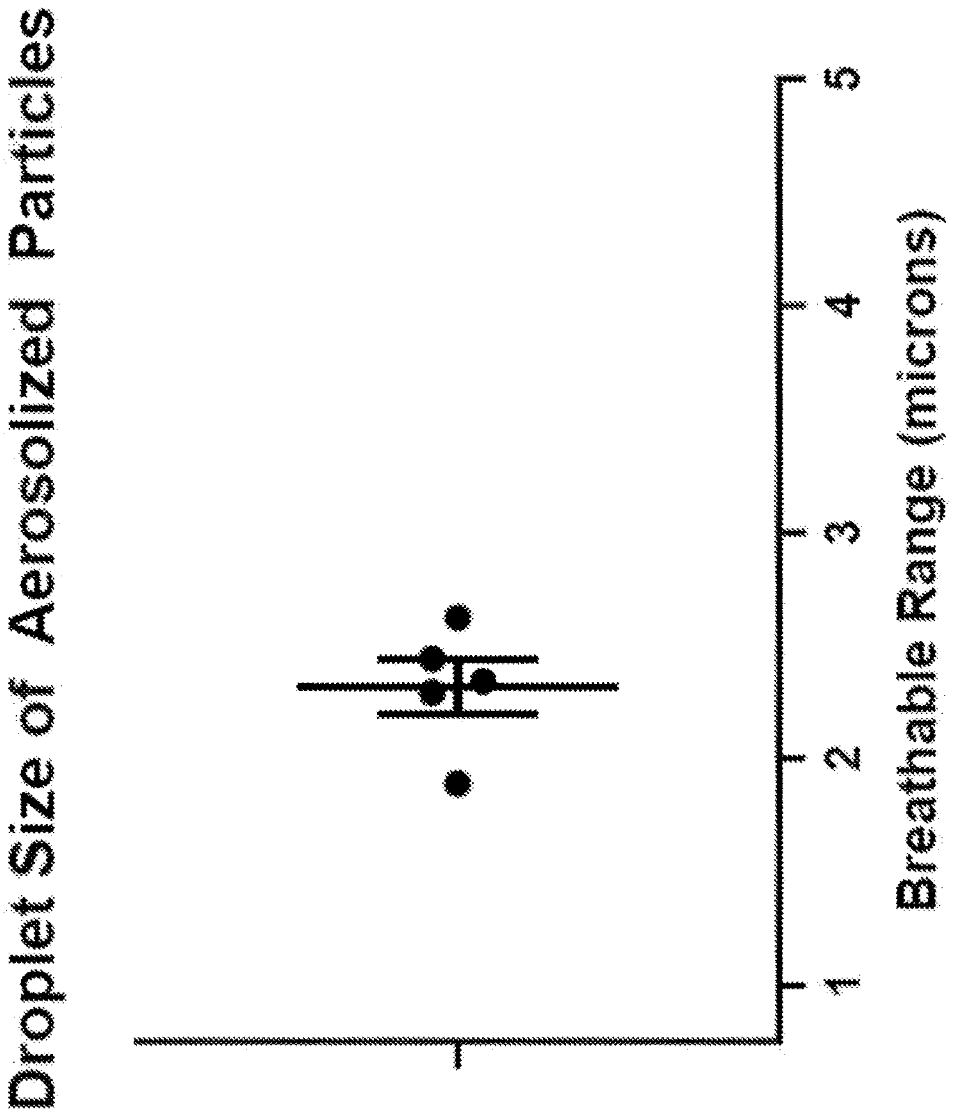
FIG. 30 shows average droplet size measurements for aerosolized lipid particles as described in Example 24.

The mRNA-lipid formulations were further studied to determine whether they could be further developed to have acceptable properties for administration by inhalation. Typically, droplet particles that are less than 5 microns in diameter are considered to be highly breathable (*Part. Fibre Toxicol.* 2013; 10:12). An mRNA-lipid formulation was prepared for nebulization by diluting with WFI at a 1:1 volume ratio, and the aerosolized composition was analyzed by a cascade impactor. The results are shown in FIG. 30. It can be seen that the droplet size was consistently in the range of 2.3-2.5 microns in all the samples analyzed. This droplet size range indicates that the lipid particles are highly breathable for lung delivery.

Example 25: Encapsulation of mRNA is Maintained Before and After Nebulization Further analysis was conducted to ensure that lipid-formulated mRNA remained encapsulated both before and after nebulization. Six formulation lots of hCFTR mRNA-lipid formulation prepared as described in Example 1 were further prepared for nebulization by diluting with WFI at a 1:1 volume ratio. The nebulizable compositions were then analyzed by the RiboGreen fluorescent assay (Thermofisher Scientific) prior to nebulization to determine the initial percent encapsulation and percent yield of mRNA. The samples were then analyzed for percent encapsulation and percent yield of mRNA after nebulization by RiboGreen assay. RiboGreen is a fluorescent dye that is used in the detection and quantification of nucleic acids, including mRNA. In its free form, RiboGreen by itself exhibits little fluorescence and possesses a negligible absorbance signature. When bound to nucleic acids, the dye fluoresces with an intensity that is several orders of magnitude greater than the unbound form. The fluorescence can be detected by a sensor and the nucleic acid can be quantified.

Figure 31:
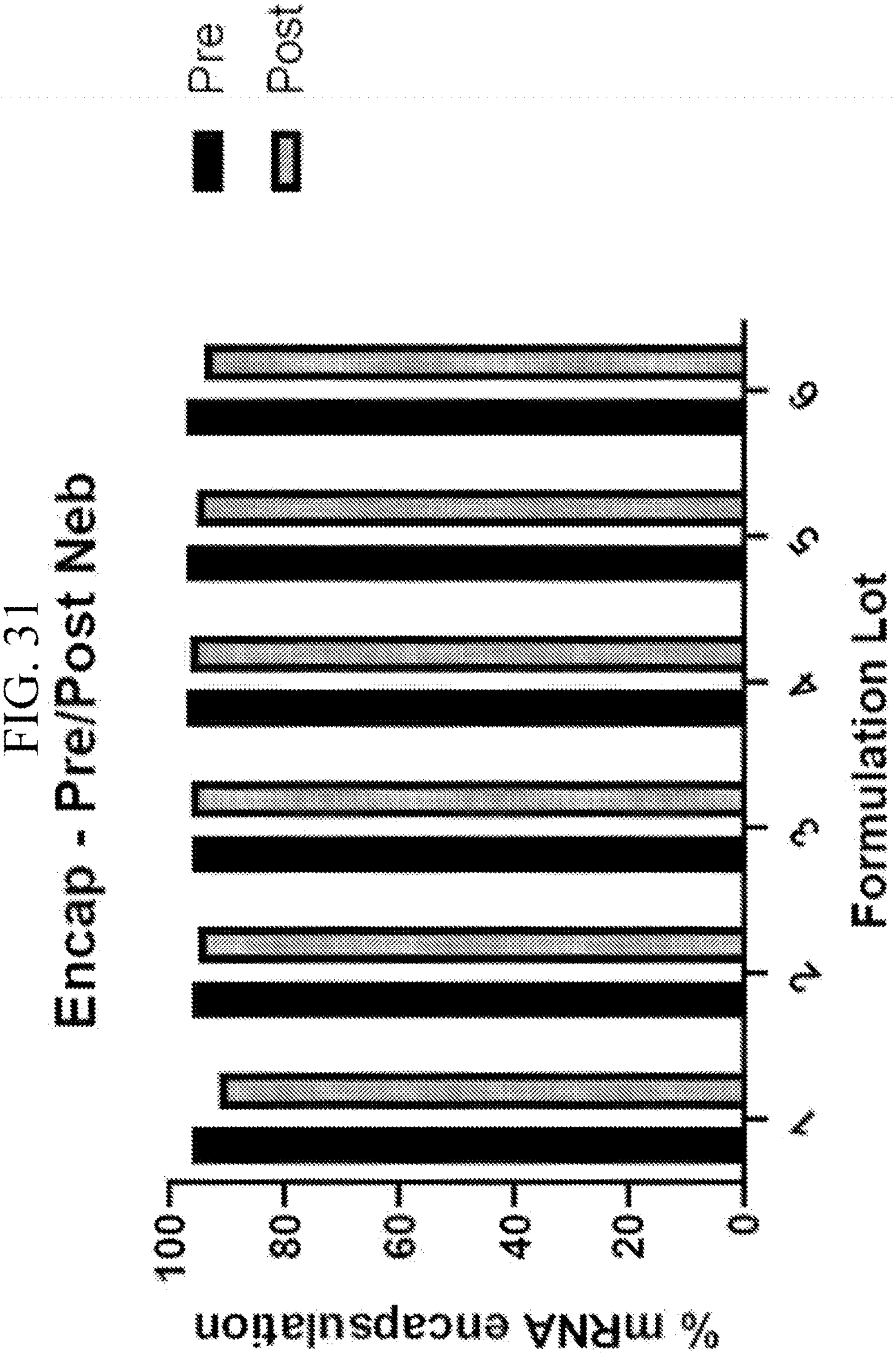
FIG. 31 shows percentage mRNA encapsulation measured by RiboGreen assay for various lots of mRNA lipid formulation both before and after nebulization as described in Example 25.
Figure 32:
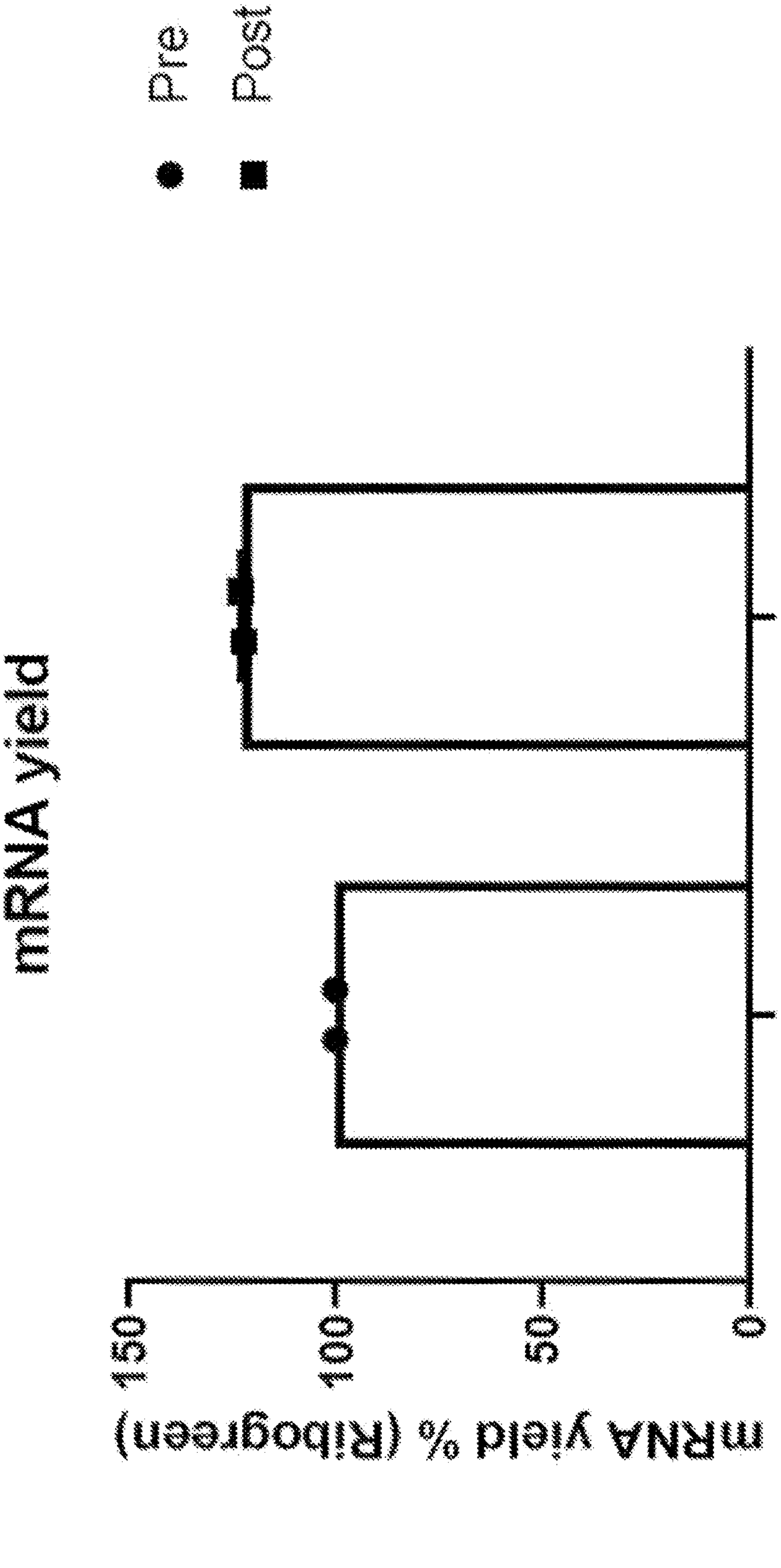
FIG. 32 shows the percent recovery of mRNA measured by RiboGreen assay for lipid formulated mRNAs both pre- and post-nebulization as described in Example 25.

The results for percent encapsulation analysis are shown in FIG. 31. It can be seen that lipid particle integrity was maintained above at least about 90% both pre- and post-nebulization for all formulation lots tested. Thus, the lipid formulations described herein show good integrity. In addition, the results for average mRNA yield percent are shown in FIG. 32 and indicate that lipid-formulated mRNA exhibited a highly efficient recovery post-nebulization. Thus, the lipid formulations adequately encapsulate and protect the mRNA.

Example 26: Integrity of mRNA Pre- and Post-Nebulization is Maintained

Figure 33:
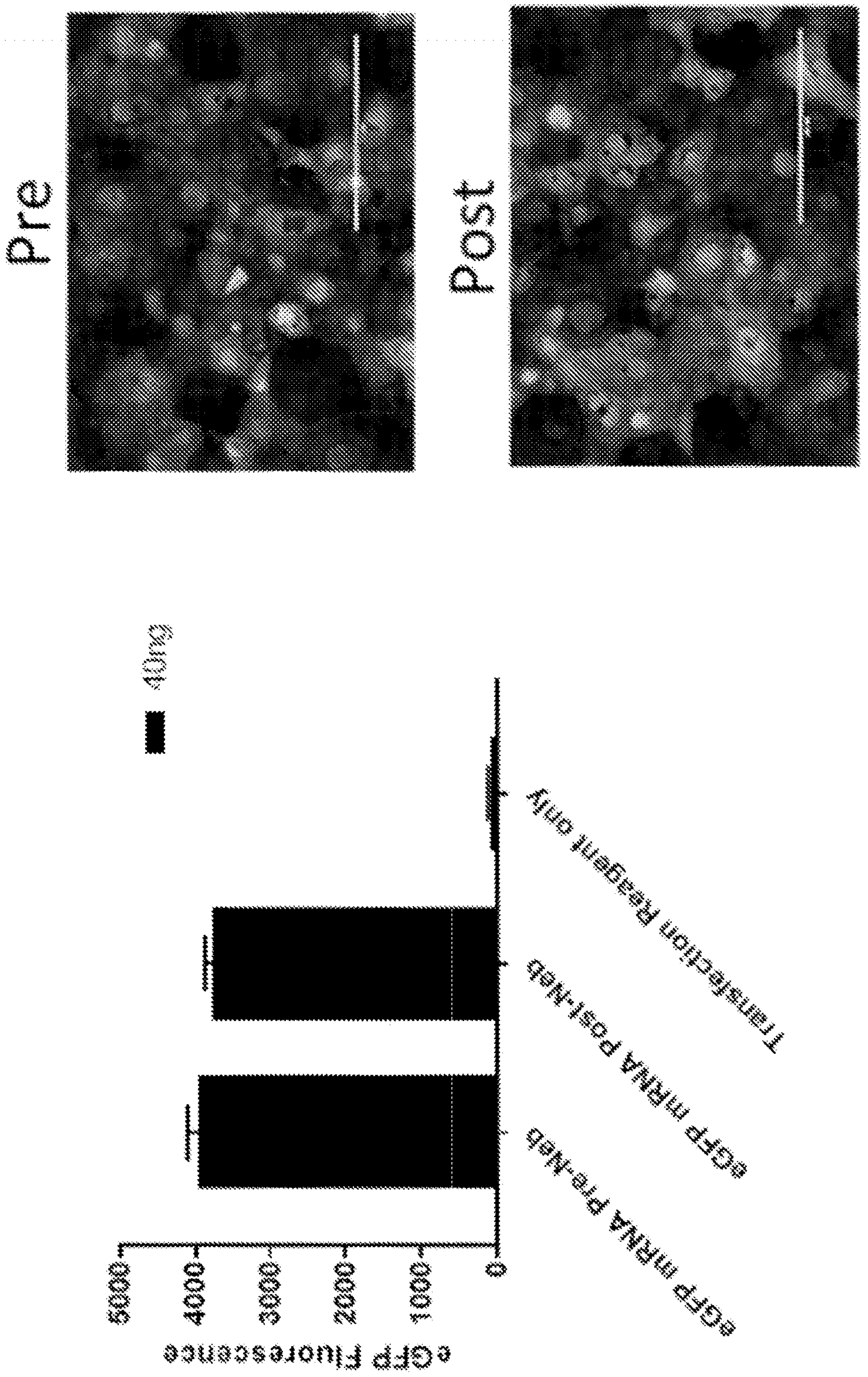
FIG. 33 shows eGFP fluorescence levels for a lipid formulated eGFP mRNA used to transfect CFBE cells pre- and post-nebulization as described in Example 26.

The ability of lipid-formulated mRNAs to transfect cells before and after nebulization was also studied. eGFP mRNA-formulations were prepared as described in Example 14 and prepared for nebulization by diluting with WFI at a 1:1 volume ratio. The nebulizable composition was aerosolized using a vibrating mesh nebulizer, which operates by vibrating many laser drilled holes at a high rate over a short distance creating a pump that draws medication through the holes and forming an incredibly small particulate mist. Pre- and post-nebulization fractions were collected, and the mRNA was extracted from the lipid formulations in both fractions. Then, the unencapsulated eGFP mRNA from each fraction was used to transfect CFBE cells, the cells were treated with an eGFP-specific antibody, and confocal fluorescence microscopy images were taken 6 hours post-transfection. The transfection reagent used was LIPOFECTAMINE 3000 (Invitrogen). Fluorescence levels were also quantified. The images shown in the right panel of FIG. 33 displayed high fluorescence in the cells both before and after nebulization, which indicates that both fractions successfully transfected the CFBE cells. Likewise, the quantitative measurements (background corrected and normalized to cell number) graphed in the left panel of FIG. 33 showed a similar degree of fluorescence for both fractions, while the negative control of transfection reagent showed no appreciable fluorescence. These results thus indicate that mRNA integrity was maintained throughout the nebulization process.

Figure 34:
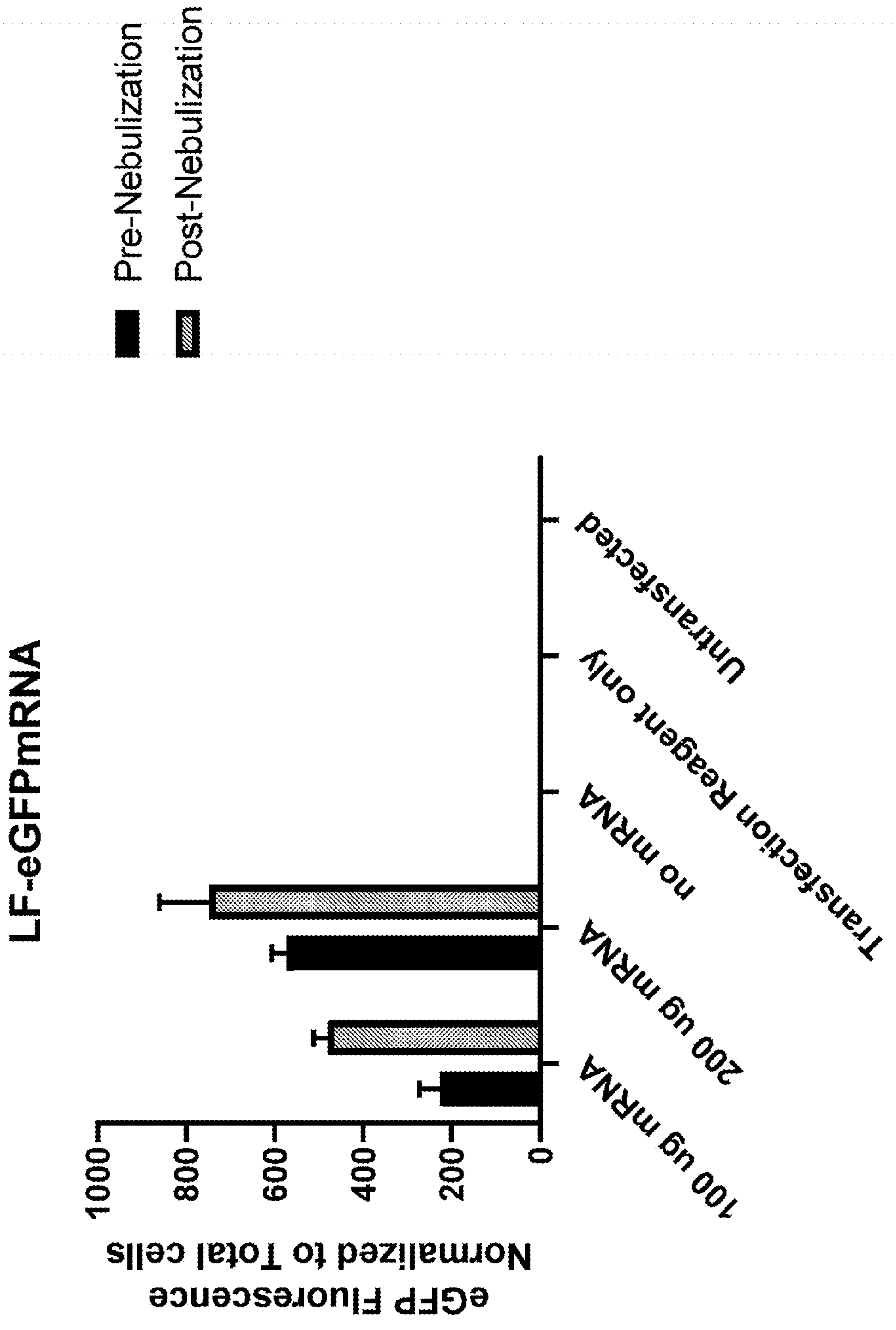
FIG. 34 shows eGFP fluorescence levels for a lipid formulated eGFP mRNA used to transfect CFBE cells at different doses pre- and post-nebulization using a vibrating mesh nebulizer as described in Example 27.

Example 27: Dose-Dependent Integrity of mRNA Pre- and Post-Nebulization is Maintained The experiments described in Example 26 were repeated in a dose-dependent manner to test whether mRNA integrity was maintained at higher doses. Pre- and post-nebulization fractions were collected and the lipid formulated-eGFP mRNA formulations from these fractions were used to transduce CFBE cells at two different doses (100 and 200 μg). Then, eGFP fluorescence levels were quantified for both fractions and transfection doses along with experiments for the negative controls of no mRNA (empty lipid particle), transfection reagent only (LIPOFECTAMINE 3000), and untransfected cells. A graph of the results is provided in FIG. 34, which shows a dose-dependent increase in fluorescence (normalized to total cells) for the lipid formulated eGFP mRNA, but no appreciable fluorescence for the negative controls. This dose-dependent increase in fluorescence indicates that kinetics and mRNA integrity were preserved throughout the nebulization process, even at higher doses.

Example 28: Ex Vivo Lung Explants—Non-CF Human Lungs

Figure 35:
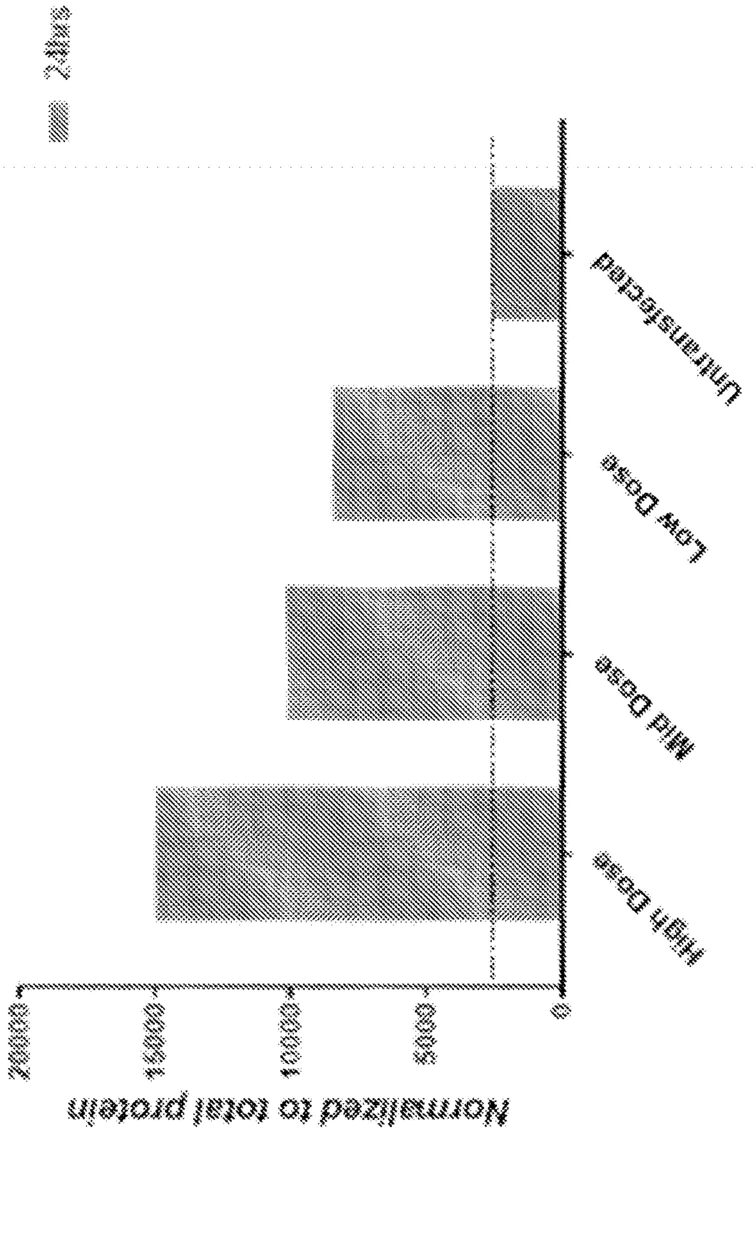
FIG. 35 shows eGFP protein quantification for three different dose levels of a eGFP mRNA-lipid formulation (LF-1) administered to lung tissue from a non-CF subject processed for WB and analyzed for eGFP expression at 24 hours post incubation as described in Example 28.
Figure 36:
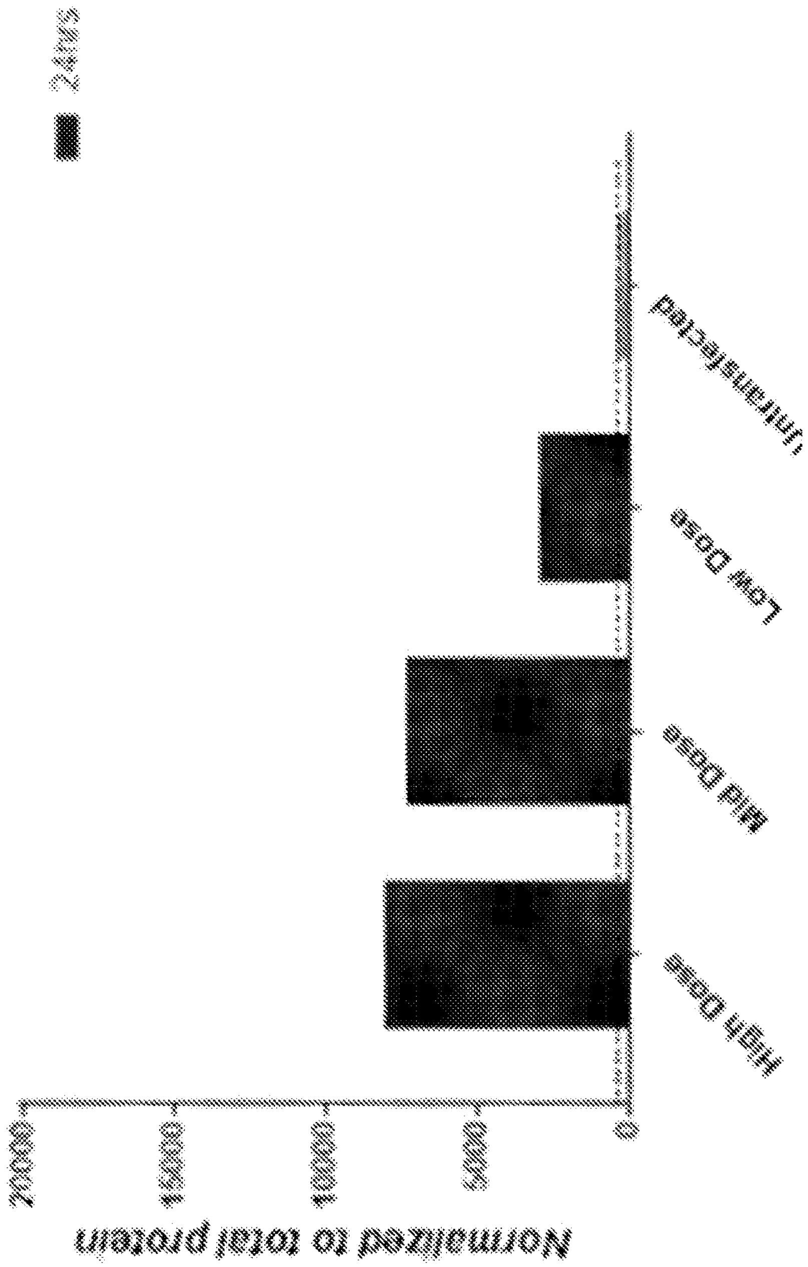
FIG. 36 shows eGFP protein quantification for three different dose levels of a eGFP mRNA-lipid formulation (LF-2) administered to lung tissue from a non-CF subject processed for WB and analyzed for eGFP expression at 24 hours post incubation as described in Example 28.
Figure 37:
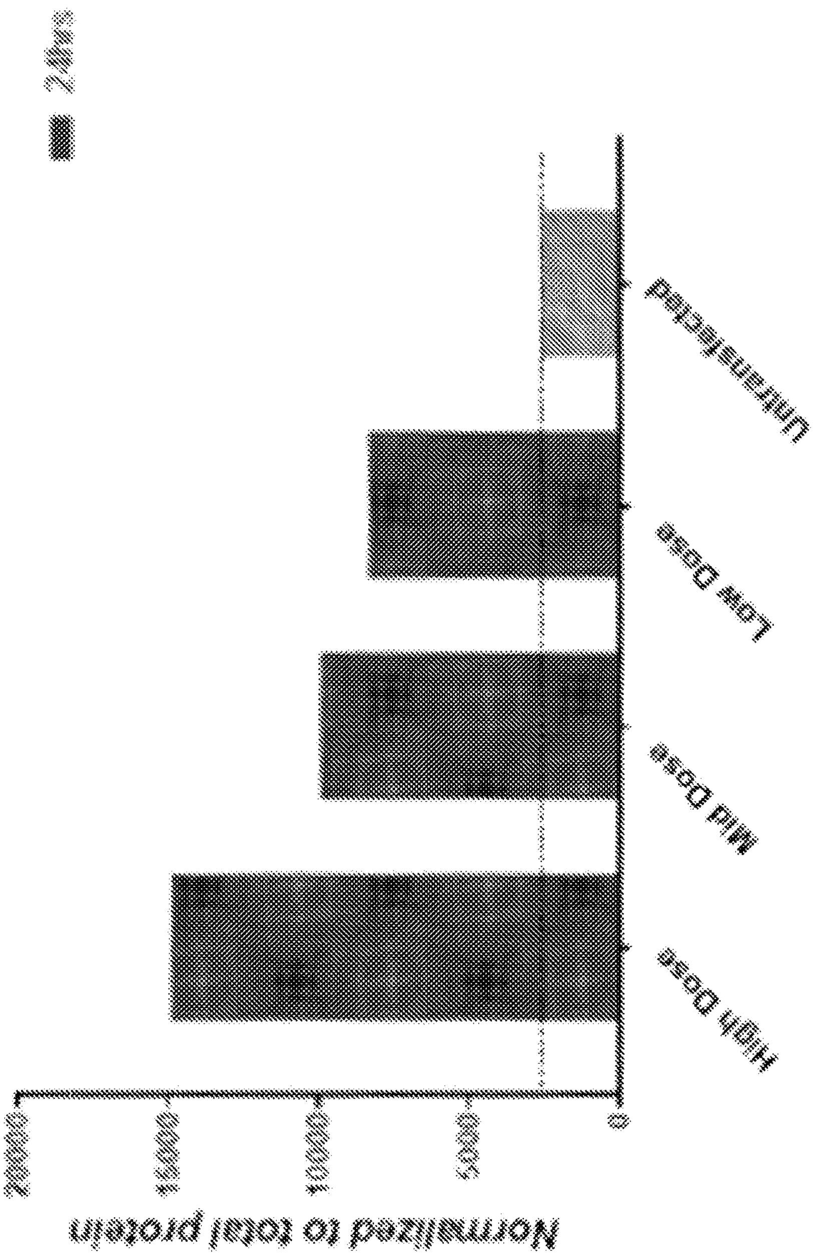
FIG. 37 shows eGFP protein quantification for three different dose levels of a eGFP mRNA-lipid formulation (LF-3) administered to lung tissue from a non-CF subject processed for WB and analyzed for eGFP expression at 24 hours post incubation as described in Example 28.

The mRNA-lipid formulations were further tested for their ability to effectively express protein in human lungs. Per the protocols described in Example 2, an extracted set of human lungs from a non-CF subject was received and insufflated with low-melting temperature agarose. A conical piece was excised and 250-micron slices were generated using a slice microtome. The slices were incubated, and cell culture medium was changed several times to remove the excess of agarose. The slices were then incubated with different eGFP mRNA-lipid formulations at three different dose levels (low, mid, and high). The lipid formulations used were LF-1 (low lipid to mRNA weight ratio), LF-2 (mid lipid to mRNA weight ratio), LF-3 (high lipid to mRNA weight ratio), which differed in composition from those used in other examples. The lipid portion of these formulations was identical and included Lipid #3, DOTAP, DSPC, cholesterol, and PEG2000-DMG in the same ratios. In addition, a sample of untransfected lung extract was tested as a negative control. Cell viability was monitored through the entire incubation process and was maintained for all the formulations and doses analyzed. 24 hours post incubation, samples were processed for WB and analyzed for eGFP expression. The eGFP band was quantified (normalized to total protein) and plotted as shown in FIG. 35 (LF-1), 36 (LF-2), and 37 (LF-3). All the formulations analyzed showed a dose-dependent increase in expression levels, indicating that the lipid formulations effectively transduced expression of mRNA in a human lung matrix.

Example 29: Ex Vivo Lung Explants—CF Human Lungs

Figure 38:
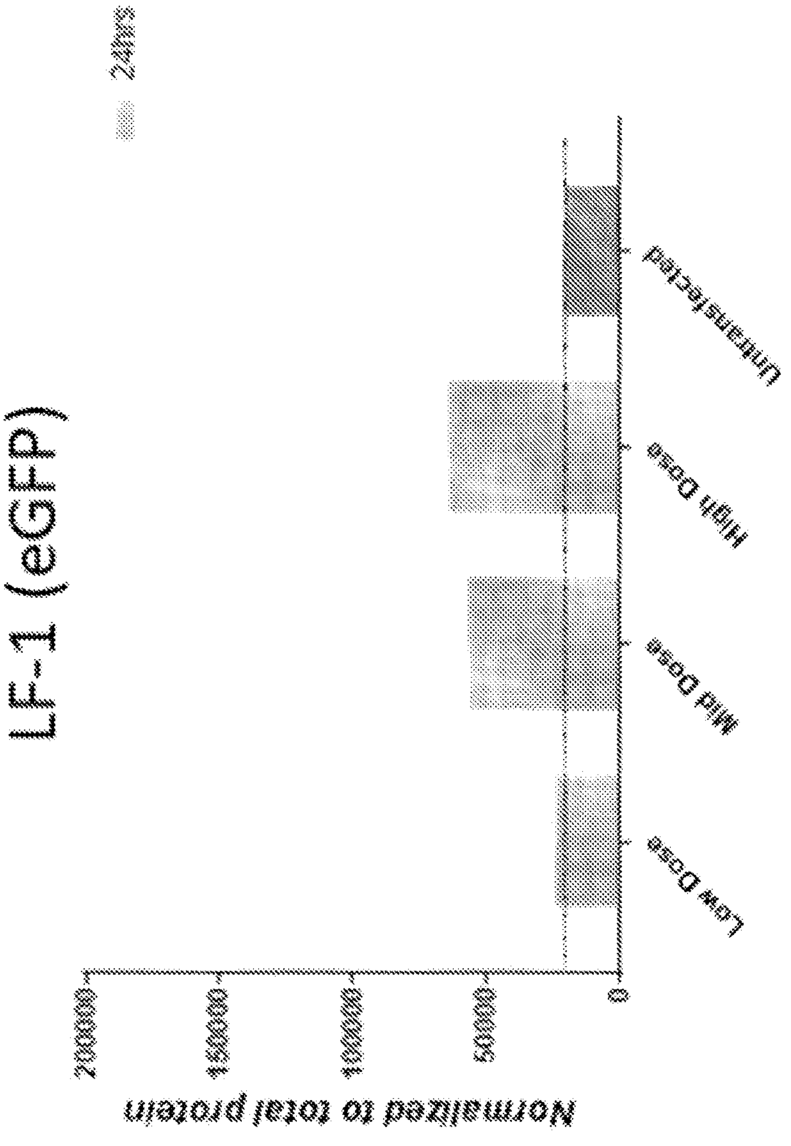
FIG. 38 shows eGFP protein quantification for three different dose levels of a eGFP mRNA-lipid formulation (LF-1) administered to lung tissue from a CF subject processed for WB and analyzed for eGFP expression at 24 hours post incubation as described in Example 29.
Figure 39:
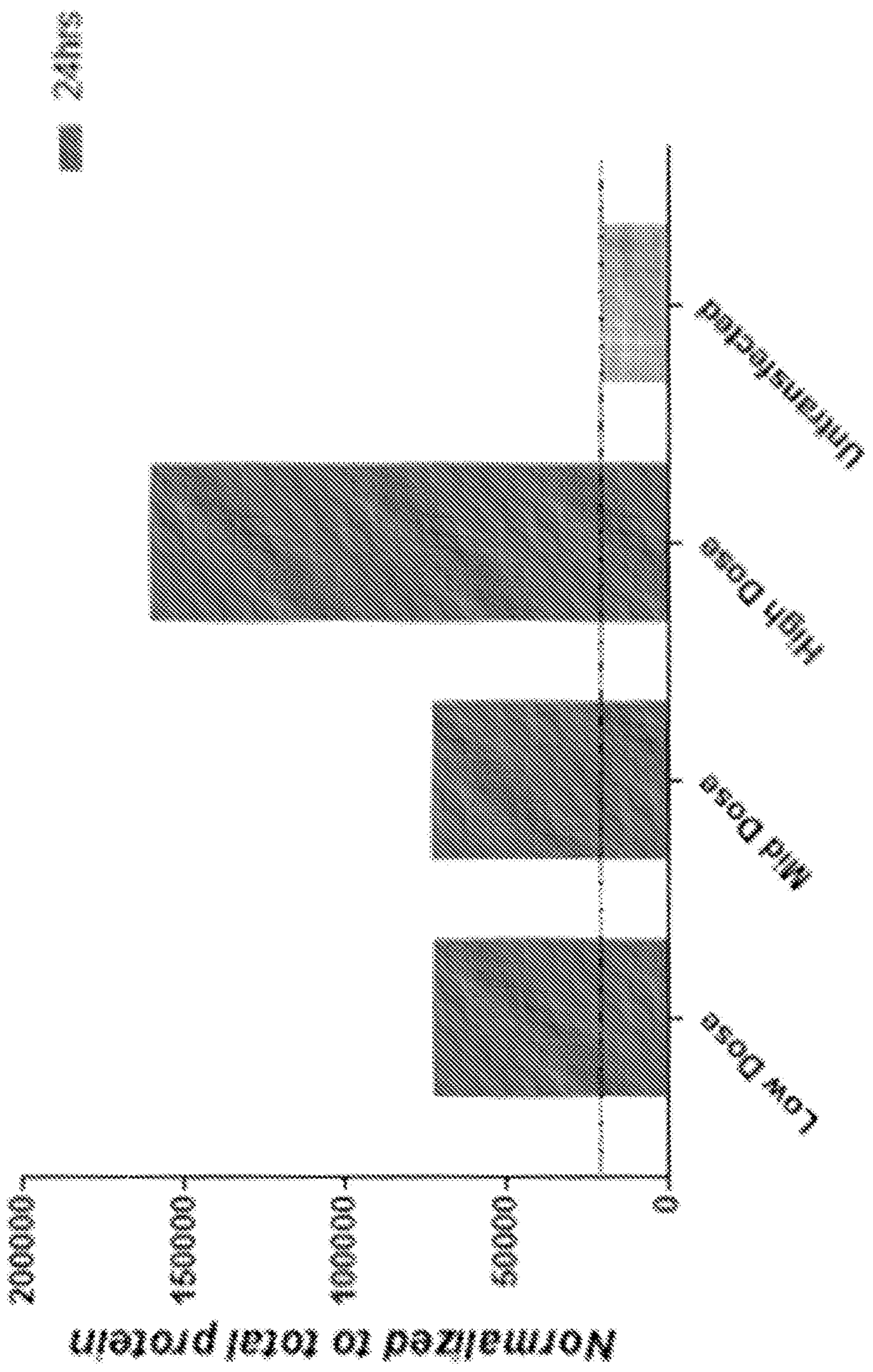
FIG. 39 shows eGFP protein quantification for three different dose levels of a eGFP mRNA-lipid formulation (LF-2) administered to lung tissue from a CF subject processed for WB and analyzed for eGFP expression at 24 hours post incubation as described in Example 29.
Figure 40:
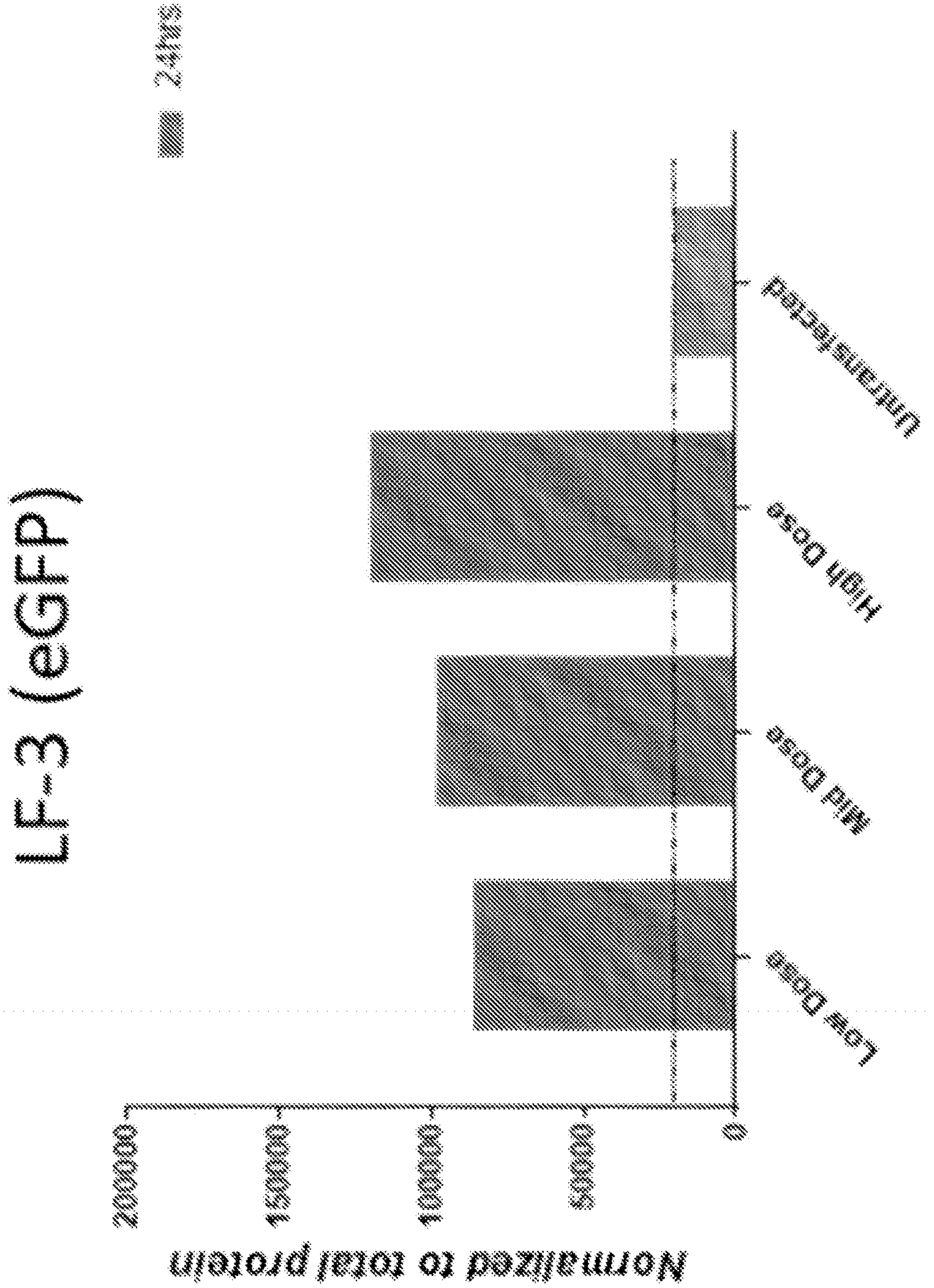
FIG. 40 shows eGFP protein quantification for three different dose levels of a eGFP mRNA-lipid formulation (LF-3) administered to lung tissue from a CF subject processed for WB and analyzed for eGFP expression at 24 hours post incubation as described in Example 29.

In tandem with the experiment of Example 28, the mRNA-lipid formulations were further tested for their ability to effectively express protein in human lungs in a CF subject. Per the protocols described in Example 2, an extracted set of human lungs from a CF subject was received and insufflated with low-melting temperature agarose. A conical piece was excised out and 250-micron slices were generated using a slice microtome. The slices were incubated, and cell culture media was changed several times to remove the excess of agarose. The slices were then incubated with different eGFP mRNA-lipid formulations at three different dose levels (low, mid and high). The lipid formulations used were LF-1, LF-2, LF-3 as described in Example 28. In addition, a sample of untransfected lung extract was tested as a negative control. Cell viability was monitored through the entire incubation process and was maintained for all the formulations and doses analyzed. 24 hours post incubation, samples were processed for WB and analyzed for eGFP expression. The eGFP band was quantified (normalized to total protein) and plotted as shown in FIG. 38 (LF-1), 39 (LF-2), and 40 (LF-3). All the formulations analyzed showed a dose-dependent increase in eGFP expression levels, indicating that the lipid formulations effectively transduced a human lung matrix of a CF subject, resulting in protein expression from transduced mRNA.

Figure 41:
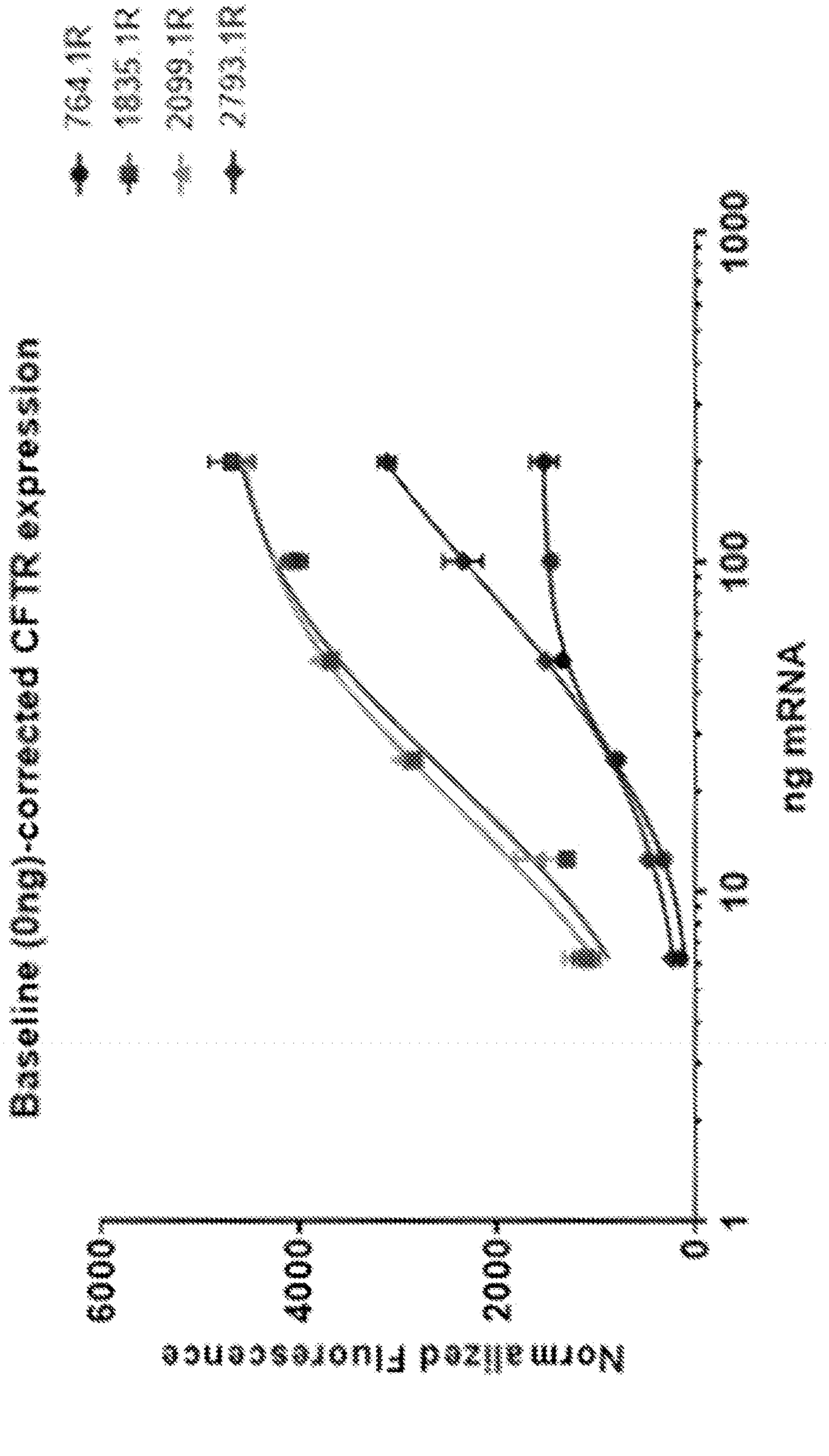
FIG. 41 shows hCFTR expression levels for selected mRNAs, reference mRNA, and a comparative mRNA transfected into CFBE cells at ascending dose levels as described in Example 30.

Example 30: Selected hCFTR mRNAs Showed Higher Expression than a Comparative Sequence The hCFTR mRNAs of the present disclosure were tested in comparison to a hCFTR mRNA sequence described in the art. CFBE cells were transfected with unformulated codon-optimized hCFTR mRNAs (construct 1835.1 having a sequence of SEQ ID NO: 53, construct 2099.1 having a sequence of SEQ ID NO: 72), the reference wild-type sequence (construct 764.1 having a sequence of SEQ ID NO: 47) and the hCFTR sequence described in U.S. Pat. Nos. 9,181,321 and 9,713,626 (listed at as SEQ ID NO: 3 therein) referred to herein as construct 2793.1 and reproduced herein for convenience as SEQ ID NO: 146. An ascending dose transfection experiment was designed and performed to determine expression levels for each of the mRNAs. The hCFTR protein expression was measured by WB per the protocols described in Example 1 using an hCFTR-specific primary antibody and the results are shown in FIG. 41. As can be seen, the data shows that compound 2793.1 and the wild-type reference sequence had similar expression levels, at least at low doses. However, both construct 1835.1 (SEQ ID NO: 53) and construct 2099.1 (SEQ ID NO: 72) expressed significantly higher levels of protein at any given dose. Thus, the hCFTR constructs of the present disclosure demonstrate superior translation efficiency.

Example 31: Delivery of mRNA-Lipid Formulations to Ferret Epithelial Cells

The physiology and tracheobronchial tree of ferret airways are more similar to human airways than those of mice.

Unlike rodents, ferrets develop Cystic Fibrosis (CF) lung disease that is similar to CF lung disease observed in humans. Therefore, it was important to generate proof of concept of delivery in an airway model with greater similarity to human airways, such as the ferret. The ROSA26TG ferret model constitutively expresses TdTomato in the airways. Upon CRE recombination, TdTomato expression is turned off and Enhanced Green Fluorescent Protein (eGFP) expression is activated. A 0.6 mg/ml dose of CRE mRNA-lipid formulation was delivered to ROSA26TG ferret airways using a microsprayer. Seven days after dosing, when recombination was complete, the animals were sacrificed, and the lungs were removed and analyzed by immunohistochemistry for both TdTomato and eGFP expression. DAPI was used as a counterstain.

Figures 42A, 42B, 42C, 42D:
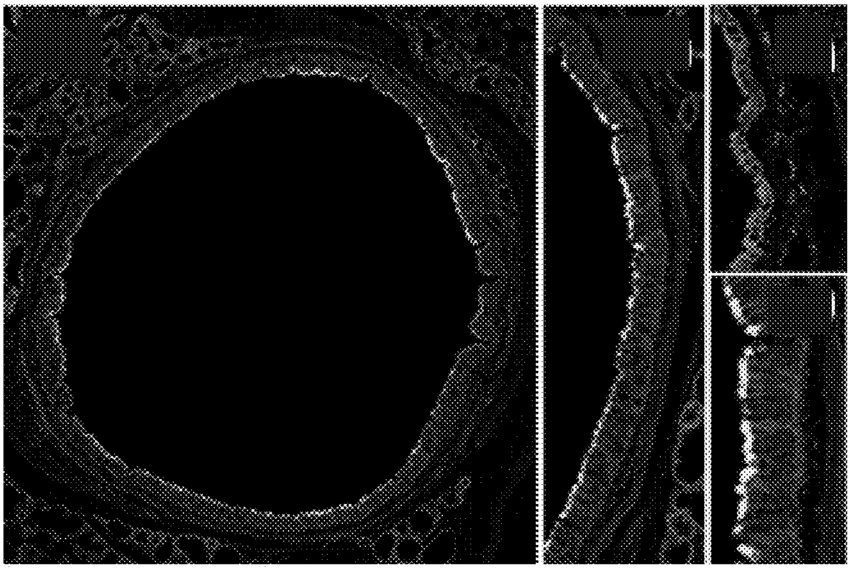
FIGS. 42A-42D show delivery of lipid-formulated mRNA to ferret lung epithelial cells, as described in Example 31.
Figure 43A:
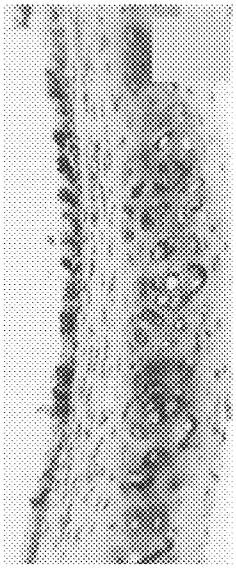
FIGS. 43A-43D show delivery of lipid-formulated mRNA to non-human primate (NHP) lung epithelial cells, as described in Example 32. NHPs treated with lipid formulated-TdTomato mRNA showed clear mRNA delivery to ciliated-like cells in epithelial airways, as seen by dark staining of cells lining the airway (FIGS. 43A-43C). By contrast, NHPs treated with PBS control showed no TdTomato expression (FIG. 43D).
Figure 43B:
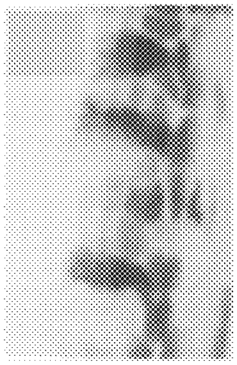
Figure 43C:
Figure 43D:
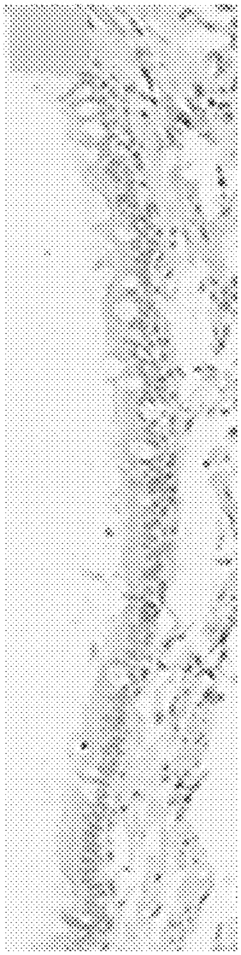

Animals treated with CRE mRNA-lipid formulation showed clear delivery of CRE mRNA to epithelial cells, as indicated by eGFP expression (FIG. 42, panels A-C, bright staining surrounding the airway). Thus, treatment of animals with lipid formulated-CRE mRNA resulted in clear transduction of cells in the epithelium. By contrast, untreated controls showed only TdTomato expression due to a lack of CRE recombination (FIG. 42, panel D).

These results show efficient delivery of mRNA-lipid formulation to ferret lung epithelial cells.

Example 32: Delivery of mRNA-Lipid Formulations to Non-Human Primate Epithelial Cells Non-human primate (NHP) airways (e.g., the tracheobronchial tree) are more similar to human airways than those of any other species. Like humans, NHPs are nasal and mouth breathers, and pharmacologically, findings observed in an NHP by delivering an aerosolized drug are likely to be more relevant to human pathology than findings from any other species. Therefore, the NHP model was used to aerosolize lipid formulated-mRNA compounds using a face mask nebulization system.

A 1 mg/ml dose of aerosolized lipid formulated-TdTomato mRNA was delivered to non-human primate (NHP) airways using a face mask exposure system. The NHPs were exposed to the mRNA formulation for 120 minutes. Forty-eight hours post-administration, the animals were sacrificed, and the lungs were removed and analyzed by immunohistochemistry for expression of the TdTomato protein. Cresyl Violet was used as a counterstain.

NHPs treated with lipid formulated-TdTomato mRNA showed clear mRNA delivery to ciliated-like cells in epithelial airways, as seen by dark staining of cells lining the airway (FIG. 43, panels A-C). By contrast, NHPs treated with PBS control showed no TdTomato expression (FIG. 43, panel D).

These results show efficient delivery of mRNA-lipid formulation to NHP lung epithelial cells.

Figure 44:
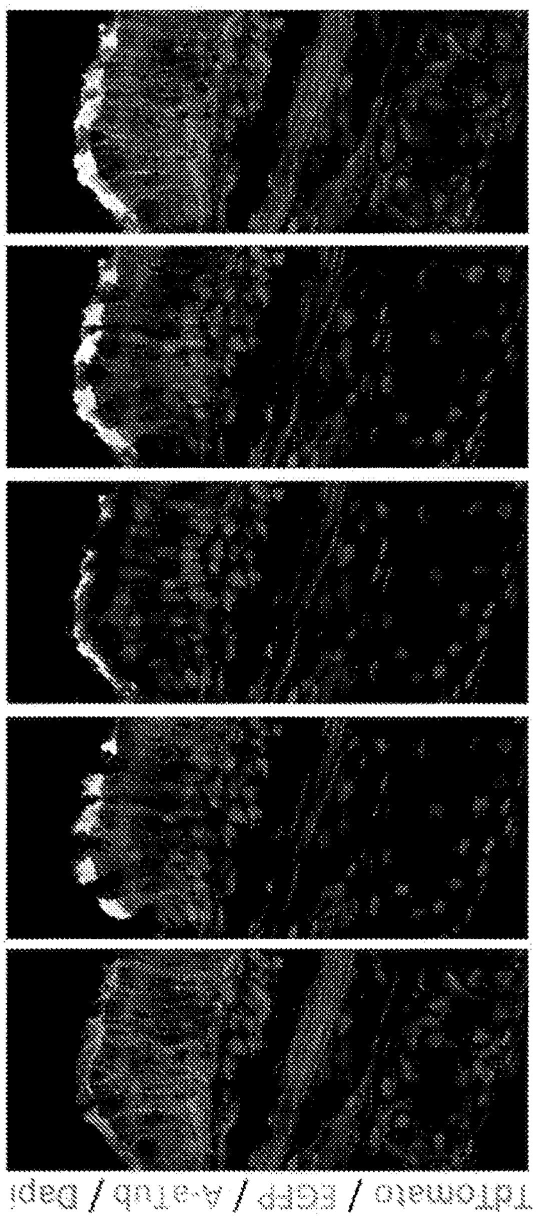
FIG. 44 shows delivery of lipid-formulated mRNA to ciliated epithelial cells of ferret lungs, as described in Example 33.

Example 33: Delivery of mRNA-Lipid Formulations to Ciliated Epithelial Cells of Ferret Airways Two 0.6 mg/ml doses, separated 48 hours apart, of lipid formulated-CRE mRNA were delivered to ROSA26TG ferret airways using a microsprayer to provide for robust delivery for immunofluorescence analysis. Upon CRE recombination, TdTomato expression is turned off and eGFP expression is activated. Seven days after delivery, when recombination is complete, animals were sacrificed, and lungs were removed and analyzed by immunofluorescence for co-localization of TdTomato, eGFP, and the ciliated cell marker Acetylated Alpha-Tubulin (A-aTub; FIG. 44). DAPI was used as a counterstain (FIG. 44, all panels). FIG. 44: first panel from left—TdTomato; second panel from left—eGFP; third panel from left—A-aTub; fourth panel from left—overlay of eGFP, A-aTub, and DAPI; fifth panel from left—overlay of TdTomato, eGFP, A-aTub, and DAPI.

TdTomato staining was seen throughout the tissue section, including in cells lining the airways (FIG. 44, first and fifth panels from left). eGFP and A-aTub staining was seen in cells lining the airways (FIG. 44, bright staining, second and third panels from left, respectively). Co-localization of eGFP and Acetylated-Alpha Tubulin indicated efficient delivery to ciliated epithelial cells (FIG. 44, fourth and fifth panels from left).

These results show efficient delivery of mRNA-lipid formulation to ciliated cells of ferret lung epithelium.

Example 34: Intranasal Administration of Lipid-Formulated hCFTR

This example illustrates intranasal administration of lipid-formulated hCFTR mRNA in a Class I CFTR knock-out (KO) mouse model.

Figure 45:
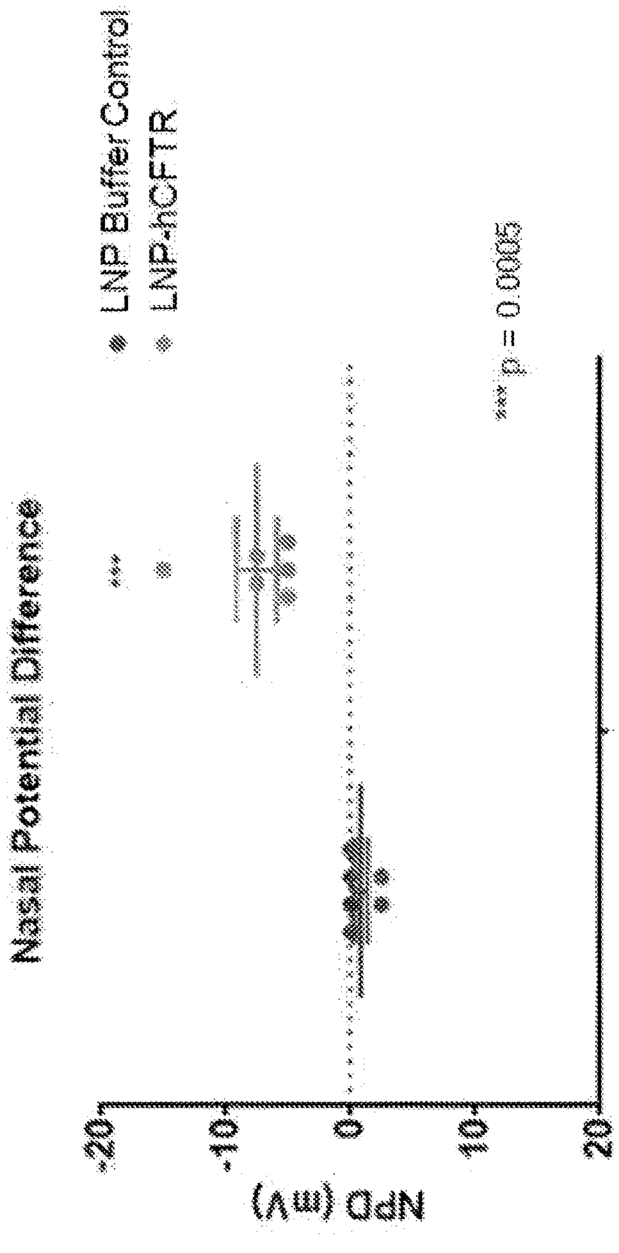
FIG. 45 shows intranasal administration of LNP-hCFTR mRNA in a Class I CFTR knockout (KO) mouse model, as described in Example 34.

A codon-optimized hCFTR mRNA formulated as a lipid nanoparticle (LNP) was administered intranasally to CFTR KO mice at a dose of 1 mg/kg/day on two days. LNP buffer was used as a negative control. 72 hours after administration, nasal potential difference (NPD) was measured to determine the voltage across the nasal epithelium. All animals that had received hCFTR mRNA showed a statistically significant increase in chloride channel activity as compared to controls that did not show activity (FIG. 45).

These results show that intranasal delivery of lipid-formulated hCFTR mRNA results in expression of functional hCFTR in the nasal epithelium as seen by chloride channel activity.

Example 35: Comparison of Single and Multiple Administrations of LNP-hCFTR mRNA This example illustrates the effect of single versus multiple administrations of LNP-hCFTR mRNA.

A Class I CFTR knockout (KO) mouse model (McHugh et al., 2018; PLOS One, 13(6):e0199573) was used to compare the effect of administration of a single higher or full dose of LNP-hCFTR mRNA versus administration of multiple lower doses that resulted in administration of the same total amount of LNP-hCFTR as compared to the higher or full dose. LNP-hCFTR mRNA was administered intranasally at a single dose of 2 mg/kg or at multiple doses of 0.4 mg/kg on each of five consecutive days. 72 hours post-administration, nasal potential difference (NPD) was measured.

Figure 46:
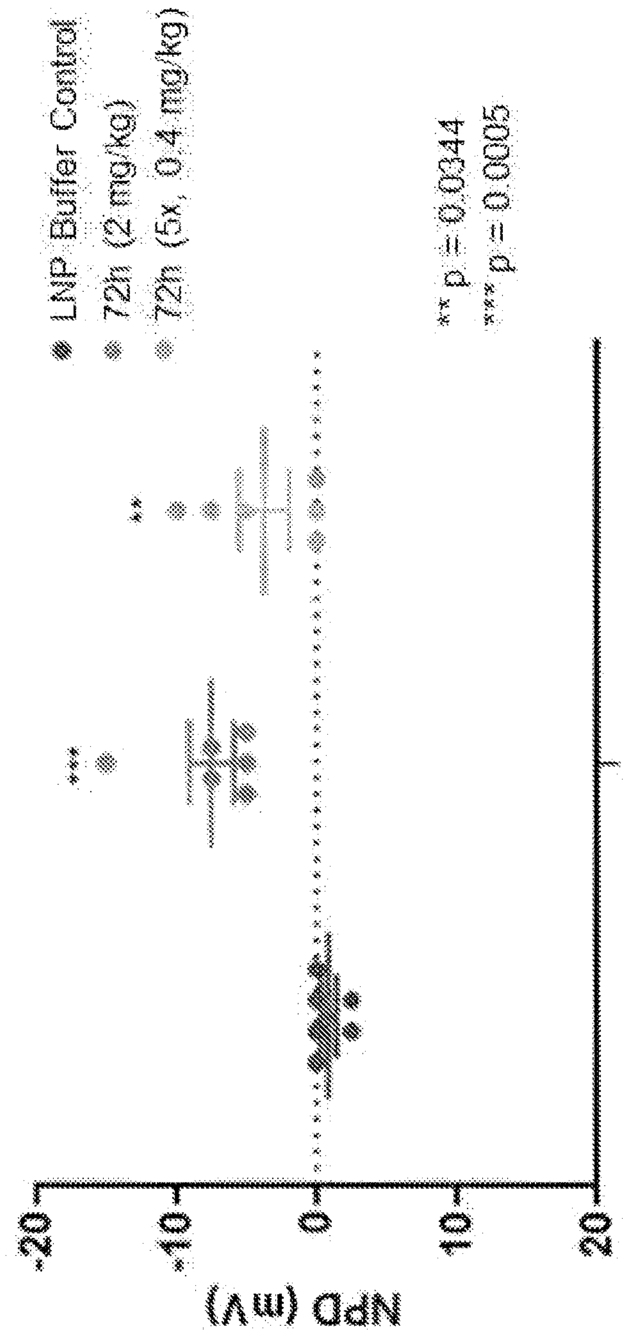
FIG. 46 shows the effect of administering single doses as compared to multiple doses of LNP-hCFTR mRNA, as described in Example 35.

Animals that had received a single full dose or multiple lower doses of LNP-hCFTR mRNA showed significant levels of chloride channel activity as compared to controls that had received LNP buffer (FIG. 46). All animals that had received a single full dose of LNP-hCFTR mRNA showed chloride channel activity, whereas 50% of animals that had received multiple lower doses of LNP-hCFTR mRNA showed chloride channel activity (FIG. 46). Thus, without being limited by theory, administration of the single full dose of LNP-hCFTR mRNA resulted in greater efficacy of delivery and chloride channel activity as compared to administration of multiple lower doses of LNP-hCFTR mRNA. As a control, animals that had received LNP buffer did not show chloride channel activity.

These data show that administration of a single full dose of LNP-hCFTR mRNA results in greater efficacy of functional hCFTR expression in nasal epithelium as compared to administration of multiple smaller doses in a CFTR KO model.

Example 36: Expression of Functional hCFTR in a CFTR-Deficient Ferret Cells

This example illustrates LNP-mediated delivery of hCFTR mRNA to CFTR-deficient ferret cells.

Figure 47:
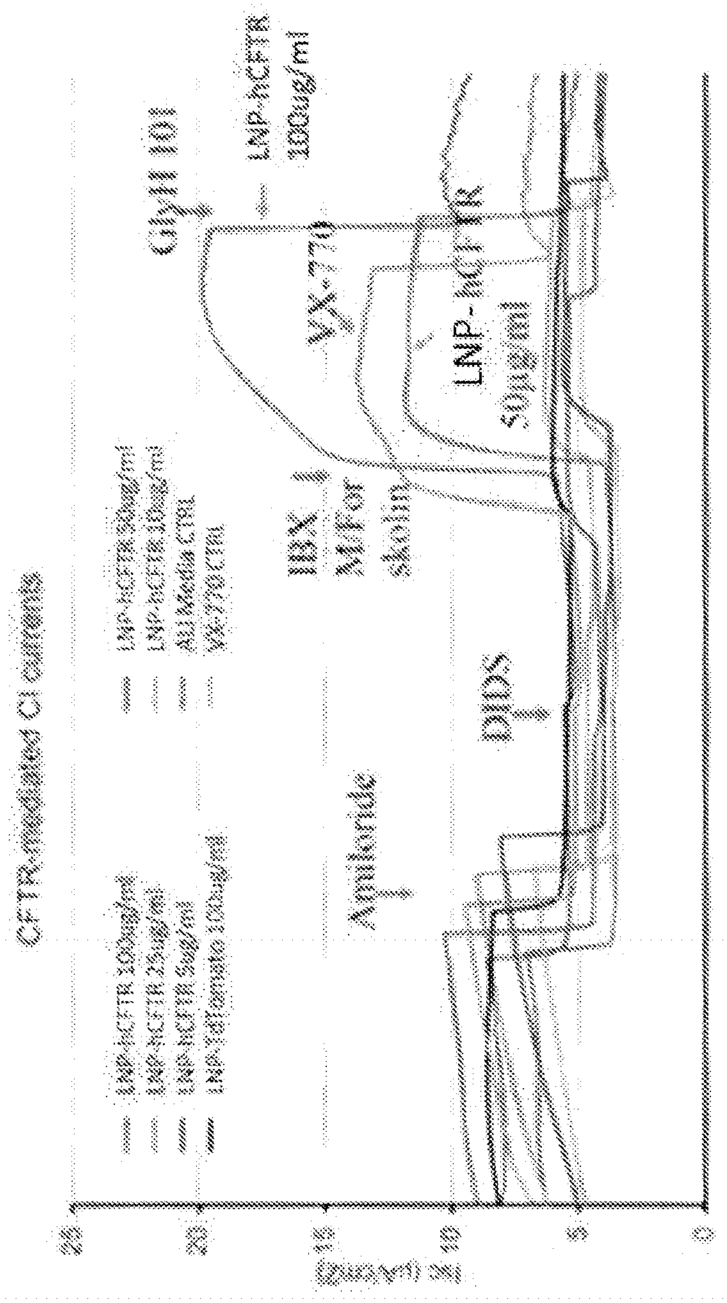
FIG. 47 shows delivery of LNP-hCFTR to ferret bronchial epithelial (FBE) cells carrying a CFTR G551D mutation, as described in Example 36.

LNP-hCFTR mRNA was used to transduce ferret bronchial epithelial (FBE) cells carrying a G551D CFTR mutation. FBE cells were cultured at the air-liquid interface (ALI). LNP-mRNA formulations were administered apically at doses ranging from 5 g/ml to 100 g/ml. VX770 was used at a dose of 3 μM for the purpose of comparison. Untreated cells and LNP-TdTomato mRNA-treated cells were used as controls. 48 hours post-administration, transepithelial chloride currents (TECC) were measured (FIG. 47). Amiloride was used to inhibit the epithelial sodium channel (ENaC). Forskolin was used to activate CFTR-dependent channels, followed by use of GlyH 101 to inhibit the channels.

TECC data showed a dose response for increasing amounts of LNP-hCFTR mRNA administered, with the highest doses tested resulting in comparable or higher CFTR activity than that seen with a 3 μM dose of VX770.

These results show that LNP-mediated delivery of hCFTR mRNA results in expression of functional CFTR proteins in CFTR-deficient ferret epithelial cells, a relevant model with lung physiology and airway cell biology more similar to humans than to mouse.

Example 37: LNP-mRNA Delivery to Human Bronchial Epithelial Cells (HBE)

This example illustrates LNP-mediated mRNA delivery to human bronchial epithelial (HBE) cells.

Figure 48A:
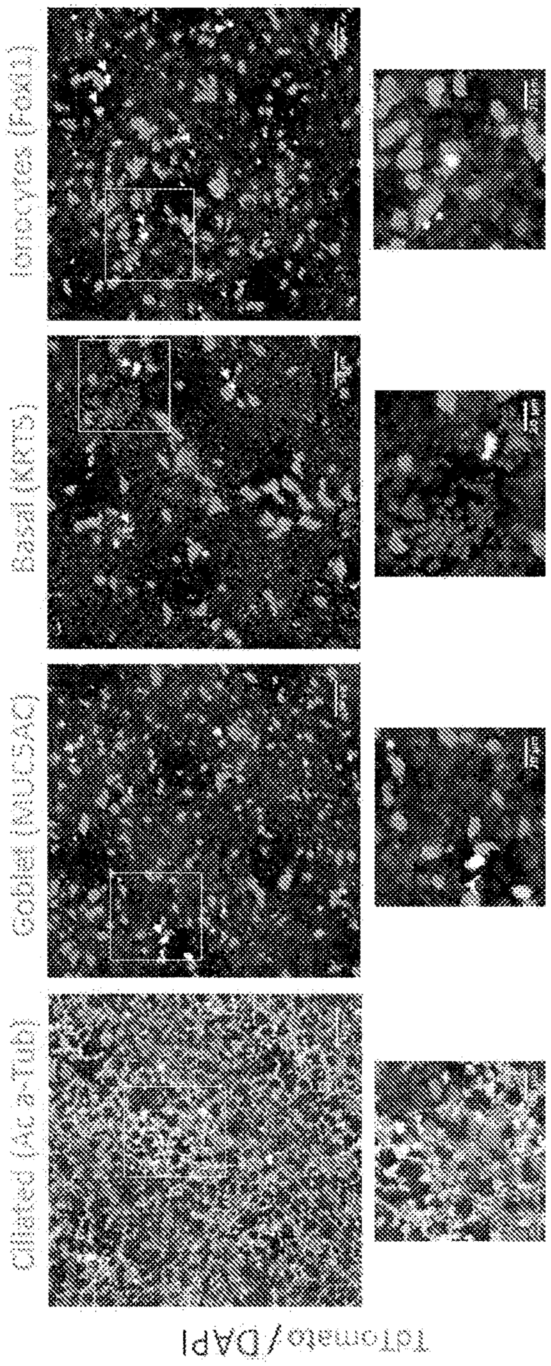
FIGS. 48A-B show delivery of LNP-mRNA to human bronchial epithelial (HBE) cells, as described in Example 37. (A) immunocytology; (B) quantitation of immunocytology results.

LNP-TdTomato mRNA was used to transduce human bronchial epithelial (HBE) cells derived from three non-CF human donors. HBE cells were cultured at the air-liquid interface (ALI). A single LNP-mRNA dose was administered apically in each well, with each administration performed in triplicate. 24 hours post-administration, cells were processed for immunocytology using antibodies for TdTomato and the indicated specific epithelial cell markers (FIG. 48A). Specifically, anti-acetylated alpha-tubulin (Ac a-Tub) antibody was used to stain ciliated cells, anti-MUC5AC antibody was used to stain goblet cells, anti-cytokeratin 5/KRT5 antibody was used to stain basal cells, and anti-Foxil antibody was used to stain ionocytes.

Figure 48B:
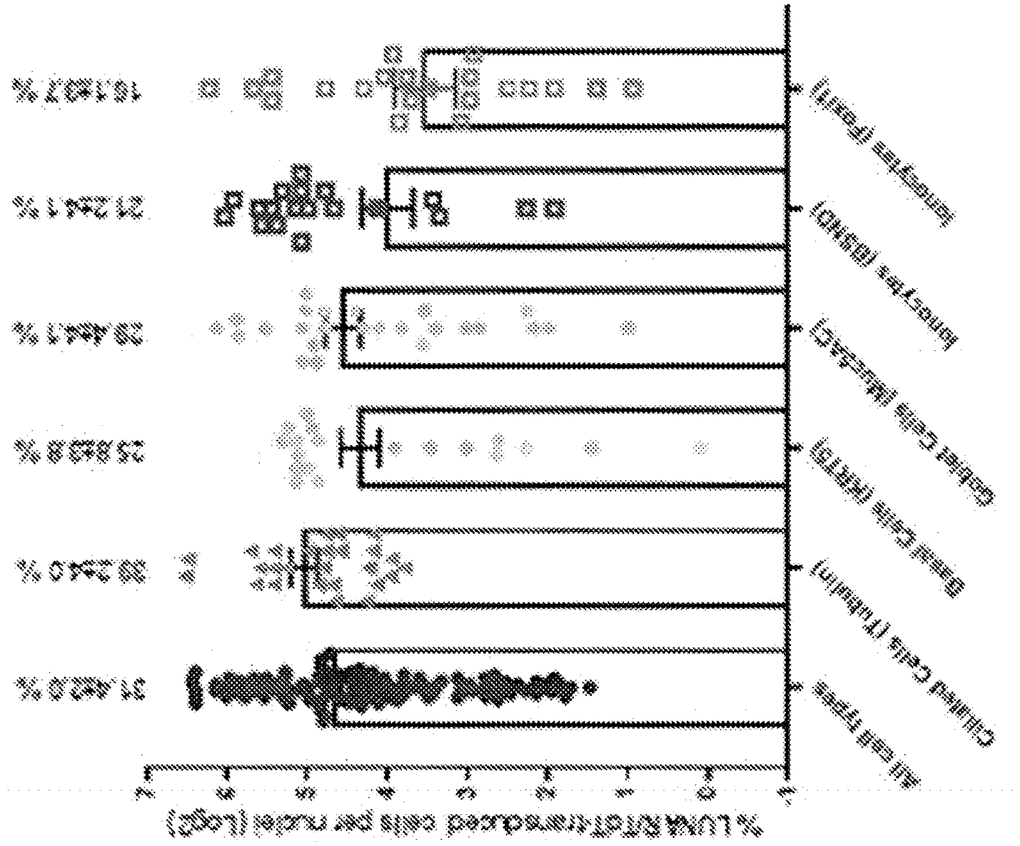

Each cell marker tested showed co-localization with TdTomato (FIG. 48A), consistent with the ability of LNPs to deliver mRNA to multiple epithelial cell types. The percentage of transduced TdTomato-positive cells within each epithelial cell population tested in culture is shown in FIG. 48B, further illustrating efficient delivery to different human epithelial cells.

These results show efficient LNP-mediated mRNA delivery to multiple human epithelial cell types.

FURTHER CONSIDERATIONS

There may be many other ways to implement the subject technology. Various functions and elements described herein may be partitioned differently from those shown without departing from the scope of the subject technology. Various modifications to these configurations will be readily apparent to those skilled in the art, and generic principles defined herein may be applied to other configurations. Thus, many changes and modifications may be made to the subject technology, by one having ordinary skill in the art, without departing from the scope of the subject technology.

It is understood that the specific order or hierarchy of steps in the processes disclosed is an illustration of exemplary approaches. Based upon design preferences, it is understood that the specific order or hierarchy of steps in the processes may be rearranged. Some of the steps may be performed simultaneously. The accompanying method claims present elements of the various steps in a sample order and are not meant to be limited to the specific order or hierarchy presented.

Although the detailed description contains many specifics, these should not be construed as limiting the scope of the subject technology but merely as illustrating different examples and aspects of the subject technology. It should be appreciated that the scope of the subject technology includes other embodiments not discussed in detail above. Various other modifications, changes and variations may be made in the arrangement, operation and details of the method and apparatus of the subject technology disclosed herein without departing from the scope of the present disclosure. Unless otherwise expressed, reference to an element in the singular is not intended to mean "one and only one" unless explicitly stated, but rather is meant to mean "one or more." In addition, it is not necessary for a device or method to address every problem that is solvable (or possess every advantage that is achievable) by different embodiments of the disclosure in order to be encompassed within the scope of the disclosure. The use herein of "can" and derivatives thereof shall be understood in the sense of "possibly" or "optionally" as opposed to an affirmative capability.

---

SEQUENCE LISTING (146 sequences)

SEQ ID NO: 1 - DNA, 4443 bp, Homo sapiens
  source 1..4443: mol_type = other DNA
atgcagaggtcgcctctggaaaaggccagcgttgtctccaaactttttttcagctggaccagaccaattttgaggaaaggatacagacagcgcctggaattgtcagacatataccaaatcccttctgttgattctgctgacaatctatctgaaaaattggaaagagaatgggatagagagctggcttcaaagaaaaatcctaaactcattaatgcccttcggcgatgttttttctggagatttatgttctatggaatctttttatatttaggggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaagactttaaagctgtcaagccgtgttctagataaaataagtattggacaacttgttagtctcctttccaacaacctgaacaaatttgatgaaggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacagagatcagagagctgggaagatcagtgaaagactcgtaattacctcagaaatgattgagaacatccaatctgttaaggcatactgctgggaagaagcaatggaaaaaatgattgaaaacttaagacaaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggatttcttacaaaagcaagaatataagacattggaatataacttaacgactacagaagtagtgatggagaatgtaacagccttctgggaggagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaagacttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggacatctccaagtttgcagagaaagacaatatagttcttggagaaggtggaatcacactgagtggaggtcaacgagcaagaatttctttagcaagagcagtatacaaagatgctgatttgtatttattagactctccttttggatacctagatgttttaacagaaaaagaaatatttgaaagctgtgtctgtaaactgatggctaacaaaactaggattttggtcacttctaaaatggaacatttaaagaaagctgacaaaatattaattttgcatgaaggtagcagctatttttatgggacattttcagaactccaaaatctacagccagactttagctcaaaactcatgggatgtgattctttcgaccaatttagtgcagaaagaagaaattcaatcctaactgagacattacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggagtgcttttttgatgatatggagagcataccagcagtgactacatggaacacataccttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacagaaagtatttattttttctggaacatttagaaaaaacttggatccctatgaacagtggagtgatcaagaaatatggaaagttgcagatgaggttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatccagtaacataccaaataattagaagaactctaaaacaagcatttgctgattgcacagtaattctctgtgaacacaggatagaagcaatgctggaatgccaacaatttttggtcatagaagagaacaaagtgcggcagtacgattccatccagaaactgctgaacgagaggagcctcttccggcaagccatcagcccctccgacagggtgaagctctttccccaccggaactcaagcaagtgcaagtctaagccccagattgctgctctgaaagaggagacagaagaagaggtgcaagatacaaggctttag

SEQ ID NO: 2 - DNA, 4443 bp, synthetic construct
  misc_feature 1..4443: note = Synthetic construct
  source 1..4443: mol_type = other DNA
atgcagaggtcgcctctggagaaggccagcgttgtctccaagctgttcttcagctggaccagaccaattttgaggaaaggatacagacagcgcctggaattgtcagacatataccaaatcccttctgttgattctgctgacaatctatctgagaagttggaaagagaatgggatagagagctggcttccaagaagaaccctaagctcattaatgcccttcggcgatgctttttctggaggttcatgttctatggaatcttcctgtacttaggggaggtcaccaaggcagtacagcctctcttgctgggcagaatcatagcttcctatgaccctgataacaaggaggaacgcagcatcgcgatctacctgggcatcggcttgtgcctgctctttatcgtgaggacactgctcctacaccctgccatctttggccttcatcacattggaatgcagatgagaatcgctatgttcagtttgatttacaagaagactttaaagctgtccagcagggtgctagataagatcagcattggacagcttgttagcctgctttccaacaacctgaacaagttcgatgaaggactggcattggcacatttcgtgtggatcgctcctctgcaagtggcactcctgatggggttgatctgggagttgctgcaggcgagcgccttctgtggacttggcttcctgatagtccttgccctgttccaggctgggctagggagaatgatgatgaagtacagagatcagagggctgggaagatcagcgagagactcgtgatcacctctgagatgatcgagaacatccagtctgtgaaggcatactgctgggaagaggcaatggagaagatgattgagaacttaagacagacagagctgaagctgactcggaaggcagcctatgtgagatacttcaacagctcagccttcttcttcagcgggttctttgtggtcttcctgtctgtgcttccctatgcactaatcaagggaatcattctgcggaagatcttcacaaccatctccttctgcattgtgctgcgcatggcggtcactcggcagtttccctgggctgtacagacatggtatgactctctgggagccatcaacaagatacaggatttcctgcagaagcaagagtataagacattggagtacaacttaacgactacagaagtagtgatggagaacgtaaccgccttctgggaggagggatttggggagttgttcgagaaagcaaagcagaacaacaataatcggaagacctccaatggtgatgacagcctcttcttcagtaacttcagccttcttggtactcctgtcctgaaggacatcaacttcaagatagagaggggacagttgttggcggttgctggatccactggagcaggcaagacttcacttctaatggtgatcatgggagaactggagcctagcgagggcaagatcaagcacagtggaaggatctcattctgttctcagttttcctggattatgcctggcaccattaaggagaacatcatctttggtgtttcctatgatgagtaccgctacagaagcgtcatcaaggcatgccaactagaagaggacatctccaagtttgcagagaaggacaatatagttcttggagaaggtggaatcacactgagtggaggtcaacgagcaagaatctctttagcaagagcagtatacaaggacgctgatttgtacttgttagactctccctttggatacctagatgtgctgaccgagaaggagatattcgaaagctgtgtctgtaagctgatggctaacaagactaggatcttggtcacttctaagatggaacacctgaagaaagctgacaagatcttgatcctgcatgaaggttctagctacttctacgggacattttcagaactccagaatctacagccagactttagctcaaagctcatgggatgtgattctttcgaccagtttagtgcagagagacggaactcaatcctaactgagacattacaccgtttctcattagaaggagatgctcctgtctcctggacagagacgaagaaacagtcttttaaacagactggagagtttggggagaaacgcaagaacagcattctcaatccaatcaactctatacgaaagttctccattgtgcagaagactcccttacagatgaatggcatcgaagaggattctgatgagcctttagagagaaggctgtccttagtaccagattctgagcagggagaggcgatactgcctcgcatcagcgtgatcagcactggccccacgcttcaggcacgaaggcgccagtctgtcctgaacctgatgacacactcagttaaccaaggtcagaacattcaccgaaagacaaccgcatccacaaggaaggtgtcactggcccctcaggcaaacttgactgaactggacatctactccagaaggttatctcaggagactggcttggagatcagtgaagagattaacgaagaggacttaaaggagtgcttctttgatgatatggagagcataccagcagtgactacatggaacacataccttaggtacatcactgtccacaagagcctgatcttcgtgctaatttggtgcttggtgatcttcctggcagaggtggctgcttctttggttgtgctgtggctccttggaaacactcctcttcaagacaaagggaatagtactcattccagcaacaattcctatgcagtgattatcaccagcaccagttcgtattatgtgttctacatttacgtgggagtagccgacactttgcttgctatgggattcttcagaggtctaccactggtgcatactctaatcacagtgtcgaagatcctgcatcacaagatgttacattctgttcttcaagcacctatgtcaaccctcaacacgttgaaggcaggtgggattctgaacaggttctccaaggatatagccatcctggatgaccttctgcctcttaccatctttgacttcatccagttgttactgatcgtgattggagctatagcagttgtcgcagtgttacaaccctacatcttcgttgcaacagtgccagtgatagtggctttcattatgttgagagcatatttcctccaaacctcacagcaactcaagcagctggaatctgaaggcaggagtccaattttcactcatcttgttacaagcctgaagggactctggacattgcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaacatcatgagtacattgcagtgggctgtgaactccagcatagatgtggatagcttgatgcgatctgtgagccgagtcttcaagttcattgacatgcccaccgagggtaagcctaccaagtccaccaagccctacaagaatggccaactctcgaaggttatgatcattgagaattcacacgtgaagaaagatgacatctggccctcagggggccaaatgactgtcaaagatctcacagccaagtacacagaaggtggaaatgccatcctggagaacatttccttcagcatcagtcctggccagagggtgggcctcttgggaagaactggatcagggaagagtactttgttatcagccttcttgagactactgaacactgaaggcgagatccagatcgatggtgtgtcttgggacagcatcactttgcaacagtggaggaaggccttcggcgtgataccacagaaggtgttcatcttctccggaaccttcaggaagaacttggatccctatgaacagtggagtgatcaggagatctggaaggttgcagatgaggttgggctcagatctgtgatagaacagtttcctgggaagcttgactttgtccttgtggatgggggctgtgtcctaagccacggccacaagcagttgatgtgcttggctagatctgttctcagtaaggcgaagatcttgctgcttgatgaacccagtgctcatttggatccagtaacataccagatcattcggagaactctgaagcaggcatttgctgattgcacagtaattctctgtgaacacaggatagaagcaatgctggaatgccaacagttcttggtcatcgaagagaacaaggtgcggcagtacgattccatccagaagctgctgaacgagaggagcctcttccggcaagccatcagcccctccgacagggtgaagctctttccccaccggaactcaagcaagtgcaagtctaagccccagatcgccgctctgaaggaagagactgaggaagaggtgcaggataccaggctgtga

SEQ ID NO: 3 - DNA, 4443 bp, synthetic construct
  misc_feature 1..4443: note = Synthetic construct
  source 1..4443: mol_type = other DNA
atgcagcgcagccccctcgagaaggccagcgtggtgagcaagctgttcttcagctggacccgccccatcctgcgcaagggctaccgccagcgcctggagctgagcgacatctaccagatccccagcgtggacagcgccgacaacctgagcgagaagctggagcgcgagtgggaccgcgagctggccagcaagaagaaccccaagctgatcaacgccctgcgccgctgcttcttctggcgcttcatgttctacggcatcttcctgtacctgggcgaggtgaccaaggccgtgcagcccctgctgctgggccgcatcatcgccagctacgaccccgacaacaaggaggagcgcagcatcgccatctacctgggcatcggcctgtgcctgctgttcatcgtgcgcaccctgctgctgcaccccgccatcttcggcctgcaccacatcggcatgcagatgcgcatcgccatgttcagcctgatctacaagaagaccctgaagctgagcagccgcgtgctggacaagatcagcatcggccagctggtgagcctgctgagcaacaacctgaacaagttcgacgagggcctggccctggcccacttcgtgtggatcgcccccctgcaggtggccctgctgatgggcctgatctgggagctgctgcaggccagcgccttctgcggcctgggcttcctgatcgtgctggccctgttccaggccggcctgggccgcatgatgatgaagtaccgcgaccagcgcgccggcaagatcagcgagcgcctggtgatcaccagcgagatgatcgagaacatccagagcgtgaaggcctactgctgggaggaggccatggagaagatgatcgagaacctgcgccagaccgagctgaagctgacccgcaaggccgcctacgtgcgctacttcaacagcagcgccttcttcttcagcggcttcttcgtggtgttcctgagcgtgctgccctacgccctgatcaagggcatcatcctgcgcaagatcttcaccaccatcagcttctgcatcgtgctgcgcatggccgtgacccgccagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagggcttcggcgagctgttcgagaaggccaagcagaacaacaacaaccgcaagaccagcaacggcgacgacagcctgttcttcagcaacttcagcctgctgggcacccccgtgctgaaggacatcaacttcaagatcgagcgcggccagctgctggccgtggccggcagcaccggcgccggcaagaccagcctgctgatggtgatcatgggcgagctggagcccagcgagggcaagatcaagcacagcggccgcatcagcttctgcagccagttcagctggatcatgcccggcaccatcaaggagaacatcatcttcggcgtgagctacgacgagtaccgctaccgcagcgtgatcaaggcctgccagctggaggaggacatcagcaagttcgccgagaaggacaacatcgtgctgggcgagggcggcatcaccctgagcggcggccagcgcgcccgcatcagcctggcccgcgccgtgtacaaggacgccgacctgtacctgctggacagccccttcggctacctggacgtgctgaccgagaaggagatcttcgagagctgcgtgtgcaagctgatggccaacaagacccgcatcctggtgaccagcaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagcgccgcaacagcatcctgaccgagaccctgcaccgcttcagcctggagggcgacgcccccgtgagctggaccgagaccaagaagcagagcttcaagcagaccggcgagttcggcgagaagcgcaagaacagcatcctgaaccccatcaacagcatccgcaagttcagcatcgtgcagaagacccccctgcagatgaacggcatcgaggaggacagcgacgagcccctggagcgccgcctgagcctggtgcccgacagcgagcagggcgaggccatcctgccccgcatcagcgtgatcagcaccggccccaccctgcaggcccgccgccgccagagcgtgctgaacctgatgacccacagcgtgaaccagggccagaacatccaccgcaagaccaccgccagcacccgcaaagtgagcctggccccccaggccaacctgaccgagctggacatctacagccgccgcctgagccaggagaccggcctggagatcagcgaggagatcaacgaggaggacctgaaggagtgcttcttcgacgacatggagagcatccccgccgtgaccacctggaacacctacctgcgctacatcaccgtgcacaagagcctgatcttcgtgctgatctggtgcctggtgatcttcctggccgaggtggccgccagcctggtggtgctgtggctgctgggcaacacccccctgcaggacaagggcaacagcacccacagccgcaacaacagctacgccgtgatcatcaccagcaccagcagctactacgtgttctacatctacgtgggcgtggccgacaccctgctggccatgggcttcttccgcggcctgcccctggtgcacaccctgatcaccgtgagcaagatcctgcaccacaagatgctgcacagcgtgctgcaggcccccatgagcaccctgaacaccctgaaggccggcggcatcctgaaccgcttcagcaaggacatcgccatcctggacgacctgctgcccctgaccatcttcgacttcatccagctgctgctgatcgtgatcggcgccatcgccgtggtggccgtgctgcagccctacatcttcgtggccaccgtgcccgtgatcgtggccttcatcatgctgcgcgcctacttcctgcagaccagccagcagctgaagcagctggagagcgagggccgcagccccatcttcacccacctggtgaccagcctgaagggcctgtggaccctgcgcgccttcggccgccagccctacttcgagaccctgttccacaaggccctgaacctgcacaccgccaactggttcctgtacctgagcaccctgcgctggttccagatgcgcatcgagatgatcttcgtgatcttcttcatcgccgtgaccttcatcagcatcctgaccaccggcgagggcgagggccgcgtgggcatcatcctgaccctggccatgaacatcatgagcaccctgcagtgggccgtgaacagcagcatcgacgtggacagcctgatgcgcagcgtgagccgcgtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagcgcgtgggcctgctgggccgcaccggcagcggcaagagcaccctgctgagcgccttcctgcgcctgctgaacaccgagggcgagatccagatcgacggcgtgagctgggacagcatcaccctgcagcagtggcgcaaggccttcggcgtgatcccccagaaggtgttcatcttcagcggcaccttccgcaagaacctggacccctacgagcagtggagcgaccaggagatctggaaggtggccgacgaggtgggcctgcgcagcgtgatcgagcagttccccggcaagctggacttcgtgctggtggacggcggctgcgtgctgagccacggccacaagcagctgatgtgcctggcccgcagcgtgctgagcaaggccaagatcctgctgctggacgagcccagcgcccacctggaccccgtgacctaccagatcatccgccgcaccctgaagcaggccttcgccgactgcaccgtgatcctgtgcgagcaccgcatcgaggccatgctggagtgccagcagttcctggtgatcgaggagaacaaggtgcgccagtacgacagcatccagaagctgctgaacgagcgcagcctgttccgccaggccatcagccccagcgaccgcgtgaagcttttcccccaccgcaacagcagcaagtgcaagagcaagccccagatcgccgccctgaaggaggagaccgaggaggaggtgcaggacacccgcctgtag

SEQ ID NO: 4 - DNA, 4443 bp, synthetic construct
  misc_feature 1..4443: note = Synthetic construct
  source 1..4443: mol_type = other DNA
atgcagaggtcgcctctggagaaggccagcgttgtctccaagctgttcttcagctggaccagaccaattttgaggaaaggatacagacagcgcctggaattgtcagacatataccaaatcccttctgttgattctgctgacaatctatctgagaagttggaaagagaatgggatagagagctggcttccaagaagaaccctaagctcattaatgcccttcggcgatgctttttctggaggttcatgttctatggaatcttcctgtacttaggggaggtcaccaaggcagtacagcctctcttgctgggcagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaagactttaaagctgtcaagccgtgttctagataaaataagtattggacaacttgttagtctcctttccaacaacctgaacaaatttgatgaaggacttgcattggcacatttcgtgtggatcgctcctctgcaagtggcactcctgatggggttgatctgggagttgctgcaggcgagcgccttctgtggacttggcttcctgatagtccttgccctgttccaggctgggctagggagaatgatgatgaagtacagagatcagagggctgggaagatcagcgagagactcgtgatcacctctgagatgatcgagaacatccagtctgtgaaggcatactgctgggaagaggcaatggagaagatgattgagaacttaagacagacagagctgaagctgactcggaaggcagcctatgtgagatacttcaacagctcagccttcttcttcagcgggttctttgtggtcttcctgtctgtgcttccctatgcactaatcaagggaatcattctgcggaagatcttcacaaccatctccttctgcattgtgctgcgcatggcggtcactcggcagtttccctgggctgtacagacatggtatgactctctgggagccatcaacaagatacaggatttcctgcagaagcaagagtataagacattggagtacaacttaacgactacagaagtagtgatggagaacgtaaccgccttctgggaggagggatttggggagttgttcgagaaagcaaagcagaacaacaataatcggaagacctccaatggtgatgacagcctcttcttcagtaacttcagccttcttggtactcctgtcctgaaggacatcaacttcaagatagagaggggacagttgttggcggttgctggatccactggagcaggcaagacttcacttctaatggtgatcatgggagaactggagcctagcgagggcaagatcaagcacagtggaaggatctcattctgttctcagttttcctggattatgcctggcaccattaaggagaacatcatctttggtgtttcctatgatgagtaccgctacagaagcgtcatcaaggcatgccaactagaagaggacatctccaagtttgcagagaaggacaatatagttcttggagaaggtggaatcacactgagtggaggtcaacgagcaagaatctctttagcaagagcagtatacaaggacgctgatttgtacttgttagactctccctttggatacctagatgtgctgaccgagaaggagatattcgaaagctgtgtctgtaagctgatggctaacaagactaggatcttggtcacttctaagatggaacacctgaagaaagctgacaagatcttgatcctgcatgaaggttctagctacttctacgggacattttcagaactccagaatctacagccagactttagctcaaagctcatgggatgtgattctttcgaccagtttagtgcagagagacggaactcaatcctaactgagacattacaccgtttctcattagaaggagatgctcctgtctcctggacagagacgaagaaacagtcttttaaacagactggagagtttggggagaaacgcaagaacagcattctcaatccaatcaactctatacgaaagttctccattgtgcagaagactcccttacagatgaatggcatcgaagaggattctgatgagcctttagagagaaggctgtccttagtaccagattctgagcagggagaggcgatactgcctcgcatcagcgtgatcagcactggccccacgcttcaggcacgaaggcgccagtctgtcctgaacctgatgacacactcagttaaccaaggtcagaacattcaccgaaagacaaccgcatccacaaggaaggtgtcactggcccctcaggcaaacttgactgaactggacatctactccagaaggttatctcaggagactggcttggagatcagtgaagagattaacgaagaggacttaaaggagtgcttctttgatgatatggagagcataccagcagtgactacatggaacacataccttaggtacatcactgtccacaagagcctgatcttcgtgctaatttggtgcttggtgatcttcctggcagaggtggctgcttctttggttgtgctgtggctccttggaaacactcctcttcaagacaaagggaatagtactcattccagcaacaattcctatgcagtgattatcaccagcaccagttcgtattatgtgttctacatttacgtgggagtagccgacactttgcttgctatgggattcttcagaggtctaccactggtgcatactctaatcacagtgtcgaagatcctgcatcacaagatgttacattctgttcttcaagcacctatgtcaaccctcaacacgttgaaggcaggtgggattctgaacaggttctccaaggatatagccatcctggatgaccttctgcctcttaccatctttgacttcatccagttgttactgatcgtgattggagctatagcagttgtcgcagtgttacaaccctacatcttcgttgcaacagtgccagtgatagtggctttcattatgttgagagcatatttcctccaaacctcacagcaactcaagcagctggaatctgaaggcaggagtccaattttcactcatcttgttacaagcctgaagggactctggacattgcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaacatcatgagtacattgcagtgggctgtgaactccagcatagatgtggatagcttgatgcgatctgtgagccgagtcttcaagttcattgacatgcccaccgagggtaagcctaccaagtccaccaagccctacaagaatggccaactctcgaaggttatgatcattgagaattcacacgtgaagaaagatgacatctggccctcagggggccaaatgactgtcaaagatctcacagccaagtacacagaaggtggaaatgccatcctggagaacatttccttcagcatcagtcctggccagagggtgggcctcttgggaagaactggatcagggaagagtactttgttatcagccttcttgagactactgaacactgaaggcgagatccagatcgatggtgtgtcttgggacagcatcactttgcaacagtggaggaaggccttcggcgtgataccacagaaggtgttcatcttctccggaaccttcaggaagaacttggatccctatgaacagtggagtgatcaggagatctggaaggttgcagatgaggttgggctcagatctgtgatagaacagtttcctgggaagcttgactttgtccttgtggatgggggctgtgtcctaagccacggccacaagcagttgatgtgcttggctagatctgttctcagtaaggcgaagatcttgctgcttgatgaacccagtgctcatttggatccagtaacataccagatcattcggagaactctgaagcaggcatttgctgattgcacagtaattctctgtgaacacaggatagaagcaatgctggaatgccaacagttcttggtcatcgaagagaacaaggtgcggcagtacgattccatccagaagctgctgaacgagaggagcctcttccggcaagccatcagcccctccgacagggtgaagctctttccccaccggaactcaagcaagtgcaagtctaagccccagatcgccgctctgaaggaagagactgaggaagaggtgcaggataccaggctgtag

SEQ ID NO: 5 - DNA, 4443 bp, synthetic construct
  misc_feature 1..4443: note = Synthetic construct
  source 1..4443: mol_type = other DNA
atgcagaggagccccctggagaaggccagcgtggtgagcaagctgttcttcagctggaccaggcccatcctgaggaagggctacaggcagaggctggagctgagcgacatctaccagatccccagcgtggacagcgccgacaacctgagcgagaagctggagagggagtgggacagggagctggccagcaagaagaaccccaagctgatcaacgccctgcggaggtgcttcttctggaggttcatgttctacggcatcttcctgtacctgggcgaggtgaccaaggccgtgcagcccctgctgctgggcaggatcatcgccagctacgaccccgacaacaaggaggagaggagcatcgccatctacctgggcatcggcctgtgcctgctgttcatcgtgaggaccctgctgctgcaccccgccatcttcggcctgcaccacatcggcatgcagatgaggatcgccatgttcagcctgatctacaagaagaccctgaagctgagcagcagggtgctggacaagatcagcatcggccagctggtgagcctgctgagcaacaacctgaacaagttcgacgagggcctggccctggcccacttcgtgtggatcgcccccctgcaggtggccctgctgatgggcctgatctgggagctgctgcaggccagcgccttctgcggcctgggcttcctgatcgtgctggccctgttccaggccggcctgggcaggatgatgatgaagtacagggaccagagggccggcaagatcagcgagaggctggtgatcaccagcgagatgatcgagaacatccagagcgtgaaggcctactgctgggaggaggccatggagaagatgatcgagaacctgaggcagaccgagctgaagctgacccggaaggccgcctacgtgaggtacttcaacagcagcgccttcttcttcagcggcttcttcgtggtgttcctgagcgtgctgccctacgccctgatcaagggcatcatcctgcggaagatcttcaccaccatcagcttctgcatcgtgctgaggatggccgtgacccggcagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagggcttcggcgagctgttcgagaaggccaagcagaacaacaacaacaggaagaccagcaacggcgacgacagcctgttcttcagcaacttcagcctgctgggcacccccgtgctgaaggacatcaacttcaagatcgagaggggccagctgctggccgtggccggcagcaccggcgccggcaagaccagcctgctgatggtgatcatgggcgagctggagcccagcgagggcaagatcaagcacagcggcaggatcagcttctgcagccagttcagctggatcatgcccggcaccatcaaggagaacatcatcttcggcgtgagctacgacgagtacaggtacaggagcgtgatcaaggcctgccagctggaggaggacatcagcaagttcgccgagaaggacaacatcgtgctgggcgagggcggcatcaccctgagcggcggccagagggccaggatcagcctggccagggccgtgtacaaggacgccgacctgtacctgctggacagccccttcggctacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagaggaggaacagcatcctgaccgagaccctgcacaggttcagcctggagggcgacgcccccgtgagctggaccgagaccaagaagcagagcttcaagcagaccggcgagttcggcgagaagaggaagaacagcatcctgaaccccatcaacagcatcaggaagttcagcatcgtgcagaagacccccctgcagatgaacggcatcgaggaggacagcgacgagcccctggagaggaggctgagcctggtgcccgacagcgagcagggcgaggccatcctgcccaggatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccccaggccaacctgaccgagctggacatctacagcaggaggctgagccaggagaccggcctggagatcagcgaggagatcaacgaggaggacctgaaggagtgcttcttcgacgacatggagagcatccccgccgtgaccacctggaacacctacctgaggtacatcaccgtgcacaagagcctgatcttcgtgctgatctggtgcctggtgatcttcctggccgaggtggccgccagcctggtggtgctgtggctgctgggcaacacccccctgcaggacaagggcaacagcacccacagcaggaacaacagctacgccgtgatcatcaccagcaccagcagctactacgtgttctacatctacgtgggcgtggccgacaccctgctggccatgggcttcttcaggggcctgcccctggtgcacaccctgatcaccgtgagcaagatcctgcaccacaagatgctgcacagcgtgctgcaggcccccatgagcaccctgaacaccctgaaggccggcggcatcctgaacaggttcagcaaggacatcgccatcctggacgacctgctgcccctgaccatcttcgacttcatccagctgctgctgatcgtgatcggcgccatcgccgtggtggccgtgctgcagccctacatcttcgtggccaccgtgcccgtgatcgtggccttcatcatgctgagggcctacttcctgcagaccagccagcagctgaagcagctggagagcgagggcaggagccccatcttcacccacctggtgaccagcctgaagggcctgtggaccctgagggccttcggccggcagccctacttcgagaccctgttccacaaggccctgaacctgcacaccgccaactggttcctgtacctgagcaccctgaggtggttccagatgaggatcgagatgatcttcgtgatcttcttcatcgccgtgaccttcatcagcatcctgaccaccggcgagggcgagggcagggtgggcatcatcctgaccctggccatgaacatcatgagcaccctgcagtgggccgtgaacagcagcatcgacgtggacagcctgatgaggagcgtgagcagggtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggcaggaccggcagcggcaagagcaccctgctgagcgccttcctgaggctgctgaacaccgagggcgagatccagatcgacggcgtgagctgggacagcatcaccctgcagcagtggaggaaggccttcggcgtgatcccccagaaggtgttcatcttcagcggcaccttcaggaagaacctggacccctacgagcagtggagcgaccaggagatctggaaggtggccgacgaggtgggcctgaggagcgtgatcgagcagttccccggcaagctggacttcgtgctggtggacggcggctgcgtgctgagccacggccacaagcagctgatgtgcctggccaggagcgtgctgagcaaggccaagatcctgctgctggacgagcccagcgcccacctggaccccgtgacctaccagatcatcaggaggaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtag

SEQ ID NO: 6 - DNA, 4443 bp, synthetic construct
  misc_feature 1..4443: note = Synthetic construct
  source 1..4443: mol_type = other DNA
atgcagaggtcgcccctggagaaggccagcgtggtgtccaagctgttcttcagctggaccaggcccatcctgaggaagggctacaggcagaggctggagctgtcagacatctaccagatcccctctgtggacagcgctgacaacctgtctgagaagctggagagggagtgggacagggagctggccagcaagaagaaccccaagctgatcaacgccctgcggaggtgcttcttctggaggttcatgttctacggaatcttcctgtacctgggggaggtgaccaaggccgtgcagcccctgctgctgggaaggatcatcgcctcctacgaccccgacaacaaggaggagaggagcatcgccatctacctgggcatcggcctgtgcctgctgttcatcgtgaggaccctgctgctgcaccccgccatcttcggcctgcaccacatcggaatgcagatgaggatcgccatgttcagcctgatctacaagaagaccctgaagctgtcaagcagggtgctggacaagatcagtatcggacagctggtgagtctgctgtccaacaacctgaacaagttcgacgagggactggccctggcccacttcgtgtggatcgctcccctgcaggtggccctgctgatggggctgatctgggagctgctgcaggccagcgccttctgcggcctgggcttcctgatcgtgctggccctgttccaggccggcctgggcaggatgatgatgaagtacagggaccagagggctggcaagatcagcgagaggctggtgatcacctcagagatgatcgagaacatccagagcgtgaaggcatactgctgggaggaggccatggagaagatgatcgagaacctgaggcagaccgagctgaagctgacccggaaggccgcctacgtgaggtacttcaacagcagcgccttcttcttctcagggttcttcgtggtgttcctgtctgtgctgccctacgccctgatcaagggcatcatcctgcggaagatcttcaccaccatctcattctgcatcgtgctgaggatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacaggaagaccagcaacggcgacgacagcctgttcttcagcaacttcagcctgctgggcacccccgtgctgaaggacatcaacttcaagatcgagaggggacagctgctggccgtggccggaagcaccggagccggcaagacctcactgctgatggtgatcatgggagagctggagccctcagagggcaagatcaagcacagtggaaggatctcattctgctctcagttcagctggatcatgcccggcaccatcaaggagaacatcatcttcggtgtgtcctacgacgagtacaggtacaggagcgtgatcaaggcctgccagctggaggaggacatcagcaagttcgcagagaaggacaacatcgtgctgggagagggtggcatcaccctgagcggaggccagagggccaggatcagcctggcaagggcagtgtacaaggacgctgacctgtacctgctggacagccccttcggatacctggacgtgctgaccgagaaggagatcttcgagagctgcgtgtgcaagctgatggccaacaagaccaggatcctggtgacctctaagatggagcacctgaagaaggctgacaagatcctgatcctgcacgagggcagcagctacttctacgggaccttcagcgagctgcagaacctgcagcccgacttcagcagcaagctgatgggctgcgacagcttcgaccagttcagcgccgagaggaggaacagcatcctgaccgagaccctgcacaggttcagcctggagggcgacgcccccgtgagctggaccgagaccaagaagcagagcttcaagcagaccggagagttcggcgagaagaggaagaacagcatcctgaaccccatcaacagcatcaggaagttcagcatcgtgcagaagacccccctgcagatgaacggcatcgaggaggacagcgacgagcccctggagaggaggctgtccctggtgcccgacagcgagcagggcgaggccatcctgcccaggatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccccaggccaacctgaccgagctggacatctacagcaggaggctgagccaggagaccggcctggagatcagcgaggagatcaacgaggaggacctgaaggagtgcttcttcgacgacatggagagcatccccgccgtgaccacctggaacacctacctgaggtacatcaccgtgcacaagagcctgatcttcgtgctgatctggtgcctggtgatcttcctggccgaggtggccgccagcctggtggtgctgtggctgctgggcaacacccccctgcaggacaagggcaacagcacccacagcaggaacaacagctacgccgtgatcatcaccagcaccagcagctactacgtgttctacatctacgtgggagtggccgacaccctgctggccatgggcttcttcaggggtctgcccctggtgcacaccctgatcaccgtgagcaagatcctgcaccacaagatgctgcacagcgtgctgcaggcccccatgagcaccctgaacaccctgaaggccggtgggatcctgaacaggttcagcaaggacatcgccatcctggacgacctgctgcccctgaccatcttcgacttcatccagctgctgctgatcgtgatcggagccatcgccgtggtggccgtgctgcagccctacatcttcgtggccaccgtgcccgtgatcgtggccttcatcatgctgagggcctacttcctgcagaccagccagcagctgaagcagctggagtctgagggcaggagtcccatcttcacccacctggtgaccagcctgaagggactgtggaccctgagggccttcggccggcagccctacttcgagaccctgttccacaaggctctgaacctgcacaccgccaactggttcctgtacctgagcaccctgaggtggttccagatgaggatcgagatgatcttcgtgatcttcttcatcgccgtgaccttcatctccatcctgaccaccggcgagggagagggaagggtgggcatcatcctgaccctggccatgaacatcatgagcaccctgcagtgggctgtgaacagcagcatcgacgtggacagcctgatgaggagcgtgagcagggtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttctcaatcagccccggccagagggtgggcctgctgggaaggaccggctcaggcaagagcaccctgctgagcgccttcctgaggctgctgaacaccgagggcgagatccagatcgacggcgtgagctgggactcaatcaccctgcagcagtggaggaaggccttcggcgtgatcccccagaaggtgttcatcttctctggaaccttcaggaagaacctggacccctacgagcagtggagcgaccaggagatctggaaggtggccgacgaggtgggcctgaggagcgtgatcgagcagttccccggcaagctggacttcgtgctggtggacgggggctgcgtgctgagccacggccacaagcagctgatgtgcctggccaggagcgtgctgagcaaggccaagatcctgctgctggacgagcccagtgcccacctggaccccgtgacctaccagatcatcaggaggaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtag

SEQ ID NO: 7 - DNA, 4443 bp, synthetic construct
  misc_feature 1..4443: note = Synthetic construct
  source 1..4443: mol_type = other DNA
atgcagaggtcgcctctggagaaggccagcgtggtgtccaagctgttcttcagctggaccagaccaatcctgaggaagggctacagacagcgcctggagctgtcagacatctaccagatcccttctgtggactctgctgacaacctgtctgagaagctggagagagagtgggacagagagctggccagcaagaagaaccctaagctgatcaacgccctgcggaggtgcttcttctggagattcatgttctacggaatcttcctgtacctgggggaggtgaccaaggccgtgcagcctctgctgctgggaagaatcatcgcctcctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagtatcggacagctggtgagtctgctgtccaacaacctgaacaagttcgacgagggactggccctggcccacttcgtgtggatcgctcctctgcaggtggccctgctgatggggctgatctgggagctgctgcaggcctctgccttctgcggcctgggcttcctgatcgtgctggccctgttccaggccggcctgggcagaatgatgatgaagtacagagaccagagagctggcaagatcagcgagagactggtgatcacctcagagatgatcgagaacatccagtctgtgaaggcatactgctgggaggaggccatggagaagatgatcgagaacctgagacagaccgagctgaagctgacccggaaggccgcctacgtgagatacttcaacagcagcgccttcttcttctcagggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccctgtgctgaaggacatcaacttcaagatcgagagaggacagctgctggccgtggccggatccaccggagccggcaagacctcactgctgatggtgatcatgggagagctggagccttcagagggcaagatcaagcacagtggaagaatctcattctgctctcagttctcctggatcatgcctggcaccatcaaggagaacatcatcttcggtgtgtcctacgacgagtacagatacagaagcgtgatcaaggcctgccagctggaggaggacatctccaagttcgcagagaaggacaacatcgtgctgggagagggtggcatcaccctgagcggaggccagagggccagaatctctctggcaagagcagtgtacaaggacgctgacctgtacctgctggactctcctttcggatacctggacgtgctgaccgagaaggagatcttcgagagctgcgtgtgcaagctgatggccaacaagaccaggatcctggtgacctctaagatggagcacctgaagaaggctgacaagatcctgatcctgcacgagggcagcagctacttctacgggaccttcagcgagctgcagaacctgcagccagacttcagcagcaagctgatgggctgcgactctttcgaccagttcagcgccgagagaagaaacagcatcctgaccgagaccctgcacaggttcagcctggagggcgacgcccctgtgtcctggaccgagaccaagaagcagtctttcaagcagaccggagagttcggcgagaagaggaagaactctatcctgaacccaatcaactctatcaggaagttctccatcgtgcagaagacccccctgcagatgaacggcatcgaggaggactctgacgagcctctggagagaaggctgtccctggtgccagactctgagcagggcgaggccatcctgcctcgcatcagcgtgatcagcaccggccccaccctgcaggccaggaggaggcagtctgtgctgaacctgatgacccacagcgtgaaccagggccagaacatccacaggaagaccaccgcctccaccaggaaggtgagcctggcccctcaggccaacctgaccgagctggacatctacagcagaaggctgtctcaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgcctctctggtggtgctgtggctgctgggcaacacccctctgcaggacaagggcaacagcacccacagcagaaacaacagctacgccgtgatcatcaccagcaccagcagctactacgtgttctacatctacgtgggagtggccgacaccctgctggccatgggcttcttcagaggtctgccactggtgcacaccctgatcaccgtgagcaagatcctgcaccacaagatgctgcactctgtgctgcaggcccctatgagcaccctgaacaccctgaaggccggtgggatcctgaacagattctccaaggacatcgccatcctggacgacctgctgcctctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagtctgagggcaggagtccaatcttcacccacctggtgaccagcctgaagggactgtggaccctgagggccttcggccggcagccttacttcgagaccctgttccacaaggctctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggctgtgaactccagcatcgacgtggacagcctgatgaggtctgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatctccttctcaatcagccctggccagagggtgggcctgctgggaagaaccggctcaggcaagagcaccctgctgagcgccttcctgagactgctgaacaccgagggcgagatccagatcgacggcgtgtcttgggactcaatcaccctgcagcagtggaggaaggccttcggcgtgatcccacagaaggtgttcatcttctctggaaccttcagaaagaacctggacccctacgagcagtggagcgaccaggagatctggaaggtggccgacgaggtgggcctgagatctgtgatcgagcagttccctggcaagctggacttcgtgctggtggacgggggctgcgtgctgagccacggccacaagcagctgatgtgcctggccagatctgtgctgagcaaggccaagatcctgctgctggacgagcccagtgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagcccctccgacagggtgaagctgttcccccaccggaacagcagcaagtgcaagtctaagccccagatcgccgccctgaaggaggagaccgaggaggaggtgcaggacaccaggctgtag

SEQ ID NO: 8 - DNA, 4443 bp, synthetic construct
  misc_feature 1..4443: note = Synthetic construct
  source 1..4443: mol_type = other DNA
atgcagaggtcgcctctggagaaggccagcgtggtgtccaagctgtttttcagctggaccagaccaatcctgaggaagggctacagacagcgcctggagctgtcagacatctaccagatcccttctgtggattctgctgacaatctgtctgagaagctggagagagagtgggatagagagctggccagcaagaagaatcctaagctgatcaatgccctgcggaggtgctttttctggagatttatgttctacggaatctttctgtacctgggggaggtgaccaaggccgtgcagcctctgctgctgggaagaatcatcgcctcctacgaccccgataacaaggaggagcgctctatcgccatctacctgggcatcggcctgtgcctgctgtttatcgtgaggacactgctgctgcacccagccatctttggcctgcaccacatcggaatgcagatgagaatcgccatgtttagcctgatctacaagaagaccctgaagctgtcaagcagggtgctggataagatcagtatcggacagctggtgagtctgctgtccaacaacctgaacaagtttgatgagggactggccctggcccacttcgtgtggatcgctcctctgcaggtggccctgctgatggggctgatctgggagctgctgcaggcctctgccttctgcggcctgggcttcctgatcgtgctggccctgtttcaggccgggctggggagaatgatgatgaagtacagagatcagagagctgggaagatcagcgagagactggtgatcacctcagagatgatcgagaatatccagtctgtgaaggcatactgctgggaggaggccatggagaagatgatcgagaacctgagacagacagagctgaagctgacccggaaggccgcctacgtgagatacttcaatagcagcgccttcttcttctcagggttctttgtggtgtttctgtctgtgctgccctacgccctgatcaagggcatcatcctgcggaagatcttcaccaccatctcattctgcatcgtgctgcgcatggccgtgacccggcagtttccctgggccgtgcagacatggtacgactctctgggagccatcaacaagatccaggatttcctgcagaagcaggagtacaagacactggagtacaacctgaccaccacagaggtggtgatggagaatgtgacagccttctgggaggagggatttggggagctgtttgagaaggccaagcagaacaataacaatagaaagacctctaatggcgatgacagcctgttcttcagtaatttcagcctgctgggcacccctgtgctgaaggatatcaatttcaagatcgagagaggacagctgctggccgtggccggatccaccggagccggcaagacctcactgctgatggtgatcatgggagagctggagccttcagagggcaagatcaagcacagtggaagaatctcattctgctctcagttttcctggatcatgcctggcaccatcaaggagaatatcatctttggtgtgtcctacgatgagtacagatacagaagcgtgatcaaggcctgccagctggaggaggacatctccaagtttgcagagaaggacaatatcgtgctgggagagggtggcatcacactgagcggaggccagagggccagaatctctctggcaagagcagtgtacaaggatgctgatctgtacctgctggactctccttttggatacctggatgtgctgacagagaaggagatctttgagagctgcgtgtgcaagctgatggccaacaagaccaggatcctggtgacctctaagatggagcacctgaagaaggctgacaagatcctgatcctgcacgagggcagcagctacttttacgggacatttagcgagctgcagaatctgcagccagactttagcagcaagctgatgggctgcgattctttcgaccagtttagcgccgagagaagaaatagcatcctgaccgagaccctgcacaggttcagcctggagggcgatgcccctgtgtcctggacagagacaaagaagcagtcttttaagcagaccggagagtttggggagaagaggaagaattctatcctgaatccaatcaactctatcaggaagttttccatcgtgcagaagacccccctgcagatgaatggcatcgaggaggattctgatgagcctctggagagaaggctgtccctggtgccagattctgagcagggcgaggccatcctgcctcgcatcagcgtgatcagcaccggccccaccctgcaggccaggaggaggcagtctgtgctgaacctgatgacacacagcgtgaaccagggccagaacatccacaggaagacaacagcctccacaaggaaggtgagcctggcccctcaggccaacctgaccgagctggatatctacagcagaaggctgtctcaggagaccggcctggagatcagtgaggagatcaacgaggaggacctgaaggagtgcttttttgatgatatggagagcatcccagccgtgaccacatggaacacatacctgaggtacatcaccgtgcacaagagcctgatctttgtgctgatctggtgcctggtgatctttctggccgaggtggccgcctctctggtggtgctgtggctgctgggcaacacccctctgcaggacaaggggaatagtacccacagcagaaataacagctacgccgtgatcatcaccagcaccagtagctactacgtgttttacatctacgtgggagtggccgacaccctgctggccatgggcttcttcagaggtctgccactggtgcacaccctgatcacagtgagcaagatcctgcaccacaagatgctgcactctgtgctgcaggcccctatgagcaccctgaacaccctgaaggccggtgggatcctgaatagattctccaaggatatcgccatcctggatgacctgctgcctctgaccatctttgacttcatccagctgctgctgatcgtgatcggagccatcgccgtggtggccgtgctgcagccctacatctttgtggccacagtgccagtgatcgtggcctttatcatgctgagagcctacttcctgcagaccagccagcagctgaagcagctggagtctgagggcaggagtccaatcttcacccacctggtgacaagcctgaagggactgtggacactgagggccttcggccggcagccttactttgagaccctgttccacaaggctctgaatctgcacaccgccaactggttcctgtacctgagcacactgcgctggttccagatgagaatcgagatgatctttgtgatcttcttcatcgccgtgaccttcatctccatcctgacaacaggcgagggagagggaagagtgggcatcatcctgaccctggccatgaatatcatgagcacactgcagtgggctgtgaactccagcatcgatgtggatagcctgatgaggtctgtgagcagggtgtttaagttcatcgacatgccaacagagggcaagcctaccaagagcaccaagccatacaagaatggccagctgagcaaggtgatgatcatcgagaatagccacgtgaagaaggatgacatctggcccagcgggggccagatgaccgtgaaggatctgacagccaagtacacagagggcggcaatgccatcctggagaacatctccttctcaatcagccctggccagagggtgggcctgctgggaagaaccggctcagggaagagtaccctgctgagcgcctttctgagactgctgaacaccgagggcgagatccagatcgatggcgtgtcttgggattcaatcaccctgcagcagtggaggaaggcctttggcgtgatcccacagaaggtgtttatcttttctggaacatttagaaagaacctggatccctacgagcagtggagcgatcaggagatctggaaggtggccgatgaggtggggctgagatctgtgatcgagcagtttcctgggaagctggactttgtgctggtggatgggggctgcgtgctgagccacggccacaagcagctgatgtgcctggccagatctgtgctgagtaaggccaagatcctgctgctggatgagcccagtgcccacctggatccagtgacataccagatcatcagaagaaccctgaagcaggcctttgccgattgcacagtgatcctgtgcgagcacaggatcgaggccatgctggagtgccagcagtttctggtgatcgaggagaacaaggtgcggcagtacgattccatccagaagctgctgaacgagaggagcctgttccggcaggccatcagcccctccgacagggtgaagctgtttccccaccggaacagcagcaagtgcaagtctaagccccagatcgccgccctgaaggaggagacagaggaggaggtgcaggatacaaggctgtag

SEQ ID NO: 9 - DNA, 4446 bp, synthetic construct
  misc_feature 1..4446: note = Synthetic construct
  source 1..4446: mol_type = other DNA
atgggccagcgcagccccctcgagaaggccagcgtggtgagcaagctgttcttcagctggacccgccccatcctgcgcaagggctaccgccagcgcctggagctgagcgacatctaccagatccccagcgtggacagcgccgacaacctgagcgagaagctggagcgcgagtgggaccgcgagctggccagcaagaagaaccccaagctgatcaacgccctgcgccgctgcttcttctggcgcttcatgttctacggcatcttcctgtacctgggcgaggtgaccaaggccgtgcagcccctgctgctgggccgcatcatcgccagctacgaccccgacaacaaggaggagcgcagcatcgccatctacctgggcatcggcctgtgcctgctgttcatcgtgcgcaccctgctgctgcaccccgccatcttcggcctgcaccacatcggcatgcagatgcgcatcgccatgttcagcctgatctacaagaagaccctgaagctgagcagccgcgtgctggacaagatcagcatcggccagctggtgagcctgctgagcaacaacctgaacaagttcgacgagggcctggccctggcccacttcgtgtggatcgcccccctgcaggtggccctgctgatgggcctgatctgggagctgctgcaggccagcgccttctgcggcctgggcttcctgatcgtgctggccctgttccaggccggcctgggccgcatgatgatgaagtaccgcgaccagcgcgccggcaagatcagcgagcgcctggtgatcaccagcgagatgatcgagaacatccagagcgtgaaggcctactgctgggaggaggccatggagaagatgatcgagaacctgcgccagaccgagctgaagctgacccgcaaggccgcctacgtgcgctacttcaacagcagcgccttcttcttcagcggcttcttcgtggtgttcctgagcgtgctgccctacgccctgatcaagggcatcatcctgcgcaagatcttcaccaccatcagcttctgcatcgtgctgcgcatggccgtgacccgccagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagggcttcggcgagctgttcgagaaggccaagcagaacaacaacaaccgcaagaccagcaacggcgacgacagcctgttcttcagcaacttcagcctgctgggcacccccgtgctgaaggacatcaacttcaagatcgagcgcggccagctgctggccgtggccggcagcaccggcgccggcaagaccagcctgctgatggtgatcatgggcgagctggagcccagcgagggcaagatcaagcacagcggccgcatcagcttctgcagccagttcagctggatcatgcccggcaccatcaaggagaacatcatcttcggcgtgagctacgacgagtaccgctaccgcagcgtgatcaaggcctgccagctggaggaggacatcagcaagttcgccgagaaggacaacatcgtgctgggcgagggcggcatcaccctgagcggcggccagcgcgcccgcatcagcctggcccgcgccgtgtacaaggacgccgacctgtacctgctggacagccccttcggctacctggacgtgctgaccgagaaggagatcttcgagagctgcgtgtgcaagctgatggccaacaagacccgcatcctggtgaccagcaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagcgccgcaacagcatcctgaccgagaccctgcaccgcttcagcctggagggcgacgcccccgtgagctggaccgagaccaagaagcagagcttcaagcagaccggcgagttcggcgagaagcgcaagaacagcatcctgaaccccatcaacagcatccgcaagttcagcatcgtgcagaagacccccctgcagatgaacggcatcgaggaggacagcgacgagcccctggagcgccgcctgagcctggtgcccgacagcgagcagggcgaggccatcctgccccgcatcagcgtgatcagcaccggccccaccctgcaggcccgccgccgccagagcgtgctgaacctgatgacccacagcgtgaaccagggccagaacatccaccgcaagaccaccgccagcacccgcaaagtgagcctggccccccaggccaacctgaccgagctggacatctacagccgccgcctgagccaggagaccggcctggagatcagcgaggagatcaacgaggaggacctgaaggagtgcttcttcgacgacatggagagcatccccgccgtgaccacctggaacacctacctgcgctacatcaccgtgcacaagagcctgatcttcgtgctgatctggtgcctggtgatcttcctggccgaggtggccgccagcctggtggtgctgtggctgctgggcaacacccccctgcaggacaagggcaacagcacccacagccgcaacaacagctacgccgtgatcatcaccagcaccagcagctactacgtgttctacatctacgtgggcgtggccgacaccctgctggccatgggcttcttccgcggcctgcccctggtgcacaccctgatcaccgtgagcaagatcctgcaccacaagatgctgcacagcgtgctgcaggcccccatgagcaccctgaacaccctgaaggccggcggcatcctgaaccgcttcagcaaggacatcgccatcctggacgacctgctgcccctgaccatcttcgacttcatccagctgctgctgatcgtgatcggcgccatcgccgtggtggccgtgctgcagccctacatcttcgtggccaccgtgcccgtgatcgtggccttcatcatgctgcgcgcctacttcctgcagaccagccagcagctgaagcagctggagagcgagggccgcagccccatcttcacccacctggtgaccagcctgaagggcctgtggaccctgcgcgccttcggccgccagccctacttcgagaccctgttccacaaggccctgaacctgcacaccgccaactggttcctgtacctgagcaccctgcgctggttccagatgcgcatcgagatgatcttcgtgatcttcttcatcgccgtgaccttcatcagcatcctgaccaccggcgagggcgagggccgcgtgggcatcatcctgaccctggccatgaacatcatgagcaccctgcagtgggccgtgaacagcagcatcgacgtggacagcctgatgcgcagcgtgagccgcgtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagcgcgtgggcctgctgggccgcaccggcagcggcaagagcaccctgctgagcgccttcctgcgcctgctgaacaccgagggcgagatccagatcgacggcgtgagctgggacagcatcaccctgcagcagtggcgcaaggccttcggcgtgatcccccagaaggtgttcatcttcagcggcaccttccgcaagaacctggacccctacgagcagtggagcgaccaggagatctggaaggtggccgacgaggtgggcctgcgcagcgtgatcgagcagttccccggcaagctggacttcgtgctggtggacggcggctgcgtgctgagccacggccacaagcagctgatgtgcctggcccgcagcgtgctgagcaaggccaagatcctgctgctggacgagcccagcgcccacctggaccccgtgacctaccagatcatccgccgcaccctgaagcaggccttcgccgactgcaccgtgatcctgtgcgagcaccgcatcgaggccatgctggagtgccagcagttcctggtgatcgaggagaacaaggtgcgccagtacgacagcatccagaagctgctgaacgagcgcagcctgttccgccaggccatcagccccagcgaccgcgtgaagcttttcccccaccgcaacagcagcaagtgcaagagcaagccccagatcgccgccctgaaggaggagaccgaggaggaggtgcaggacacccgcctgtag

SEQ ID NO: 10 - DNA, 4443 bp, synthetic construct
  misc_feature 1..4443: note = Synthetic construct
  source 1..4443: mol_type = other DNA
atgcagaggagccccctggagaaggctagcgtggtgagcaagctgttcttcagctggaccaggcccatcctgaggaagggctacaggcagaggctggagctgagcgacatctaccagatccccagcgtggacagcgccgacaacctgagcgagaagctggagagggagtgggacagggagctggccagcaagaagaaccccaagctgatcaacgccctgcggaggtgcttcttctggaggttcatgttctacggcatcttcctgtacctgggcgaggtgaccaaggccgtgcagcccctgctgctgggcaggatcatcgccagctacgaccccgacaacaaggaggagaggagcatcgccatctacctgggcatcggcctgtgcctgctgttcatcgtgaggaccctgctgctgcaccccgccatcttcggcctgcaccacatcggcatgcagatgaggatcgccatgttcagcctgatctacaagaagaccctgaagctgagcagcagggtgctggacaagatcagcatcggccagctggtgagcctgctgagcaacaacctgaacaagttcgacgagggcctggccctggcccacttcgtgtggatcgcccccctgcaggtggccctgctgatgggcctgatctgggagctgctgcaggccagcgccttctgcggcctgggcttcctgatcgtgctggccctgttccaggccggcctgggcaggatgatgatgaagtacagggaccagagggccggcaagatcagcgagaggctggtgatcaccagcgagatgatcgagaacatccagagcgtgaaggcctactgctgggaggaggccatggagaagatgatcgagaacctgaggcagaccgagctgaagctgacccggaaggccgcctacgtgaggtacttcaacagcagcgccttcttcttcagcggcttcttcgtggtgttcctgagcgtgctgccctacgccctgatcaagggcatcatcctgcggaagatcttcaccaccatcagcttctgcatcgtgctgaggatggccgtgacccggcagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagggcttcggcgagctgttcgagaaggccaagcagaacaacaacaacaggaagaccagcaacggcgacgacagcctgttcttcagcaacttcagcctgctgggcacccccgtgctgaaggacatcaacttcaagatcgagaggggccagctgctggccgtggccggcagcaccggcgccggcaagaccagcctgctgatggtgatcatgggcgagctggagcccagcgagggcaagatcaagcacagcggcaggatcagcttctgcagccagttcagctggatcatgcccggcaccatcaaggagaacatcatcttcggcgtgagctacgacgagtacaggtacaggagcgtgatcaaggcctgccagctggaggaggacatcagcaagttcgccgagaaggacaacatcgtgctgggcgagggcggcatcaccctgagcggcggccagagggccaggatcagcctggccagggccgtgtacaaggacgccgacctgtacctgctggacagccccttcggctacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagaggaggaacagcatcctgaccgagacactgcacaggttcagcctggagggcgacgcccccgtgagctggaccgagacaaagaagcagagcttcaagcagaccggcgagttcggcgagaagaggaagaacagcatcctgaaccccatcaacagcatcaggaagttcagcatcgtgcagaagacccccctgcagatgaacggcatcgaggaggacagcgacgagcccctggagaggaggctgagcctggtgcccgacagcgagcagggcgaggccatcctgcccaggatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccccaggccaacctgaccgagctggacatctacagcaggaggctgagccaggagacaggcctggagatcagcgaggagatcaacgaggaggacctgaaggagtgcttcttcgacgacatggagagcatccccgccgtgaccacctggaacacctacctgaggtacatcaccgtgcacaagagcctgatcttcgtgctgatctggtgcctggtgatcttcctggccgaggtggccgccagcctggtggtgctgtggctgctgggcaacacccccctgcaggacaagggcaacagcacccacagcaggaacaacagctacgccgtgatcatcaccagcaccagcagctactacgtgttctacatctacgtgggcgtggccgacaccctgctggccatgggcttcttcaggggcctgcccctggtgcacaccctgatcaccgtgagcaagatcctgcaccacaagatgctgcacagcgtgctgcaggcccccatgagcaccctgaacaccctgaaggccggcggcatcctgaacaggttcagcaaggacatcgccatcctggacgacctgctgcccctgaccatcttcgacttcatccagctgctgctgatcgtgatcggcgccatcgccgtggtggccgtgctgcagccctacatcttcgtggccaccgtgcccgtgatcgtggccttcatcatgctgagggcctacttcctgcagaccagccagcagctgaagcagctggagagcgagggcaggagccccatcttcacccacctggtgaccagcctgaagggcctgtggaccctgagggccttcggccggcagccctacttcgagacactgttccacaaggccctgaacctgcacaccgccaactggttcctgtacctgagcaccctgaggtggttccagatgaggatcgagatgatcttcgtgatcttcttcatcgccgtgaccttcatcagcatcctgaccaccggcgagggcgagggcagggtgggcatcatcctgaccctggccatgaacatcatgagcaccctgcagtgggccgtgaacagcagcatcgacgtggacagcctgatgaggagcgtgagcagggtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggcaggaccggcagcggcaagagcaccctgctgagcgccttcctgaggctgctgaacaccgagggcgagatccagatcgacggcgtgagctgggacagcatcaccctgcagcagtggaggaaggccttcggcgtgatcccccagaaggtgttcatcttcagcggcaccttcaggaagaacctggacccctacgagcagtggagcgaccaggagatctggaaggtggccgacgaggtgggcctgaggagcgtgatcgagcagttccccggcaagctggacttcgtgctggtggacggcggctgcgtgctgagccacggccacaagcagctgatgtgcctggccaggagcgtgctgagcaaggccaagatcctgctgctggacgagcccagcgcccacctggaccccgtgacctaccagatcatcaggaggaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagacagaggaggaggtgcaggacaccaggctgtag

SEQ ID NO: 11 - DNA, 4443 bp, synthetic construct
  misc_feature 1..4443: note = Synthetic construct
  source 1..4443: mol_type = other DNA
atgcagaggtcccccttggaaaaagcctccgtggtgtctaaattgttcttctcctggacaaggcccatattgaggaaaggatacaggcagaggttggaattgtccgacatataccagataccctccgtggactccgccgacaacttgtccgaaaaattggaaagggaatgggatagggaattggcctccaaaaaaaaccccaaattgataaacgccttgaggaggtgcttcttctggaggttcatgttctacggaatattcttgtacttgggagaagtgacaaaagccgtgcagcccttgttgttgggaaggataatagcctcctacgaccccgacaacaaagaagaaaggtccatagccatatacttgggaataggattgtgcttgttgttcatagtgaggacattgttgttgcaccccgccatattcggattgcaccacataggaatgcagatgaggatagccatgttctccttgatatacaaaaaaacattgaaattgtcctccagggtgttggacaaaatatccataggacagttggtgtccttgttgtccaacaacttgaacaaattcgacgaaggattggccttggcccacttcgtgtggatagcccccttgcaggtggccttgttgatgggattgatatgggaattgttgcaggcctccgccttctgcggattgggattcttgatagtgttggccttgttccaggccggattgggaaggatgatgatgaaatatagggaccagagggccggaaaaatatccgaaaggttggtgataacatccgaaatgatagaaaacatacagtccgtgaaagcctactgctgggaagaagccatggaaaaaatgatagaaaacttgaggcagacagaattgaaattgacaaggaaagccgcctacgtgaggtacttcaactcctccgccttcttcttctccggattcttcgtggtgttcttgtccgtgttgccctacgccttgataaaaggaataatattgaggaaaatattcacaacaatatccttctgcatagtgttgaggatggccgtgacaaggcagttcccctgggccgtgcagacatggtatgactccttgggagccataaacaaaatacaggacttcttgcagaaacaggaatacaaaacattggaatacaacttgacaacaacagaagtggtgatggaaaacgtgacagccttctgggaagaaggattcggagaattgttcgaaaaagccaaacagaacaacaacaacaggaaaacatccaacggagacgactccttgttcttctccaacttctccttgttgggaacacccgtgttgaaagacataaacttcaaaatagaaaggggacagttgttggccgtggccggatccacaggagccggaaaaacatccttgttgatggtgataatgggagaattggaaccctccgaaggaaaaataaaacactccggaaggatatccttctgctcccagttctcctggataatgcccggaacaataaaagaaaacataatattcggagtgtcctacgacgaatacaggtacaggtccgtgataaaagcctgccagttggaagaagacatatccaaattcgccgaaaaagacaacatagtgttgggagaaggaggaataacattgtccggaggacagagggccaggatatccttggccagggccgtgtacaaagacgccgacttgtacttgttggactcccccttcggatacttggacgtgttgacagaaaaagaaatattcgaatcctgcgtgtgcaaattgatggccaacaaaacaaggatattggtgacatccaaaatggaacacttgaaaaaagccgacaaaatattgatattgcacgaaggatcctcctacttctacggaacattctccgaattgcagaacttgcagcccgacttctcctccaaattgatgggatgcgactcctttgaccagttctccgccgaaaggaggaactccatattgacagaaacattgcacaggttctccttggaaggagacgcccccgtgtcctggacagaaacaaaaaaacagtccttcaaacagacaggagaattcggagaaaaaaggaaaaactccatattgaaccccataaactccataaggaaattctccatagtgcagaaaacacccttgcagatgaacggaatagaagaagactccgacgaacccttggaaaggaggttgtccttggtgcccgactccgaacagggagaagccatattgcccaggatatccgtgatatccacaggacccacattgcaggccaggaggaggcagtccgtgttgaacttgatgacacactccgtgaaccagggacagaacatacacaggaaaacaacagcctccacaaggaaagtgtccttggccccccaggccaacttgacagaattggacatatactccaggaggttgtcccaggaaacaggattggaaatatccgaagaaataaacgaagaagacttgaaagaatgcttcttcgatgacatggaatccatacccgccgtgacaacatggaacacatacttgaggtacataacagtgcataaatccttgatattcgtgttgatatggtgcttggtgatattcttggctgaagtggccgcctccttggtggtgttgtggttgttgggaaacacacccttgcaggacaaaggaaactccacacactcctccaacaactcctacgccgtgataataacatccacatcctcctactacgtgttctacatatacgtgggagtggccgacacattgttggccatgggattcttcaggggattgcccttggtgcacacattgataacagtgtccaaaatattgcaccacaaaatgttgcactccgtgttgcaggcccccatgtccacattgaacacattgaaagccggaggaatattgaacaggttctccaaagacatagccatattggacgacttgttgcccttgacaatattcgacttcatacagttgttgttgatagtgataggagccatagccgtggtggccgtgttgcagccctacatattcgtggccacagtgcccgtgatagtggccttcataatgttgagggcctacttcttgcagacatcccagcagttgaaacagttggaatccgaaggaaggtcccccatattcacacacttggtgacatccttgaaaggattgtggacattgagggccttcggaaggcagccctacttcgaaacattgttccacaaagccttgaacttgcacacagccaactggttcttgtacttgtccacattgaggtggttccagatgaggatagaaatgatattcgtgatattcttcatagccgtgacattcatatccatattgacaacaggagaaggagaaggaagggtgggaataatattgacattggccatgaacataatgtccacattgcagtgggccgtgaactcctccatagacgtggactccttgatgaggtccgtgtccagggtgttcaaattcatagacatgcccacagaaggaaaacccacaaaatccacaaaaccctacaaaaacggacagttgtccaaagtgatgataatagaaaactcccacgtgaaaaaagacgacatatggccctccggaggacagatgacagtgaaagacttgacagccaaatacacagaaggaggaaacgccatattggaaaacatatccttctccatatcccccggacagagggtgggattgttgggaaggacaggatccggaaaatccacattgttgtccgccttcttgaggttgttgaacacagaaggagaaatacagatagacggagtgtcctgggactccataacattgcagcagtggaggaaagccttcggagtgataccccagaaagtgttcatattctccggaacattcaggaaaaacttggacccctacgaacagtggtccgaccaggaaatatggaaagtggccgacgaagtgggattgaggtccgtgatagaacagttccccggaaaattggacttcgtgttggtggacggaggatgcgtgttgtcccacggacacaaacagttgatgtgcttggccaggtccgtgttgtccaaagccaaaatattgttgttggacgaaccctccgcccacttggaccccgtgacataccagataataaggaggacattgaaacaggccttcgccgactgcacagtgatattgtgcgaacacaggatagaagccatgttggaatgccagcagttcttggtgatagaagaaaacaaagtgaggcagtacgactccatacagaaattgttgaacgaaaggtccttgttcaggcaggccatatccccctccgacagggtgaaattgttcccccacaggaactcctccaaatgcaaatccaaaccccagatagccgccttgaaagaagaaacagaagaagaagtgcaggacacaaggttgtag

SEQ ID NO: 12 - DNA, 4443 bp, synthetic construct
  misc_feature 1..4443: note = Synthetic construct
  source 1..4443: mol_type = other DNA
atgcagaggagccccctggagaaggctagcgtggtgagcaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagagcttcaagcagaccggagagttcggcgagaagaggaagaacagcatcctgaacccaatcaacagcatcaggaagttcagcatcgtgcagaagaccccactgcagatgaacggcatcgaggaggacagcgacgagcccctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtag

SEQ ID NO: 13 - DNA, 4443 bp, synthetic construct
  misc_feature 1..4443: note = Synthetic construct
  source 1..4443: mol_type = other DNA
atgcagaggagccccctggagaaggctagcgtggtcagcaagctgttcttcagctggaccagaccaatcctgaggaaaggatacagacagcgcctggaactgagcgacatataccaaatccccagcgtggacagcgccgacaacctaagcgagaagctggaaagagaatgggatagggagctggccagcaagaagaaccccaagctcatcaacgccctgcggcgatgcttcttctggaggttcatgttctacggaatcttcctgtacctgggggaggtcaccaaggcagtacagcccctcctgctgggcagaatcatagccagctacgaccccgacaacaaggaggaacgcagcatcgcgatctacctgggcatcggcctgtgcctgctgttcatcgtgaggacactgctcctacaccccgccatcttcggcctgcaccacatcggaatgcagatgagaatcgccatgttcagcctgatctacaagaagaccctgaagctgagcagcagggtgctagacaagatcagcatcggacagctggtgagcctgctgagcaacaacctgaacaagttcgacgaaggactggcactggcacacttcgtgtggatcgccccactgcaagtggcactcctgatggggctgatctgggagctgctgcaggcgagcgccttctgcggactgggcttcctgatagtcctggccctgttccaggccgggctagggagaatgatgatgaagtacagagaccagagggccgggaagatcagcgagagactcgtgatcaccagcgagatgatcgagaacatccagagcgtgaaggcatactgctgggaagaggcaatggagaagatgatcgagaacctgagacagacagagctgaagctgacccggaaggcagcctacgtgagatacttcaacagcagcgccttcttcttcagcgggttcttcgtggtcttcctgagcgtgctgccctacgcactaatcaagggaatcatcctgcggaagatcttcacaaccatcagcttctgcatcgtgctgcgcatggcggtcacccggcagttcccctgggccgtacagacatggtacgacagcctgggagccatcaacaagatacaggacttcctgcagaagcaagagtacaagacactggagtacaacctgacgaccacagaagtagtgatggagaacgtaaccgccttctgggaggagggattcggggagctgttcgagaaagcaaagcagaacaacaacaaccggaagaccagcaacggcgacgacagcctcttcttcagcaacttcagcctgctgggcacccccgtcctgaaggacatcaacttcaagatagagaggggacagctgctggcggtggccggaagcaccggagcaggcaagaccagcctgctaatggtgatcatgggagaactggagcccagcgagggcaagatcaagcacagcggaaggatcagcttctgcagccagttcagctggatcatgcccggcaccatcaaggagaacatcatcttcggcgtgagctacgacgagtaccgctacagaagcgtcatcaaggcatgccaactagaagaggacatcagcaagttcgcagagaaggacaacatagtgctgggagaaggcggaatcacactgagcggaggccaacgagcaagaatcagcctggcaagagcagtatacaaggacgccgacctgtacctgctggacagccccttcggatacctagacgtgctgaccgagaaggagatattcgaaagctgcgtctgcaagctgatggccaacaagaccaggatcctggtcaccagcaagatggaacacctgaagaaagccgacaagatcctgatcctgcacgaaggcagcagctacttctacgggacattcagcgaactccagaacctacagccagacttcagcagcaagctcatgggatgcgacagcttcgaccagttcagcgcagagagacggaacagcatcctaaccgagacactgcacaggttcagcctggaaggagacgcccccgtcagctggacagagacgaagaaacagagcttcaaacagaccggagagttcggggagaaacgcaagaacagcatcctcaacccaatcaacagcatacgaaagttcagcatcgtgcagaagaccccactgcagatgaacggcatcgaagaggacagcgacgagcccctggagagaaggctgagcctggtaccagacagcgagcagggagaggcgatactgccccgcatcagcgtgatcagcaccggccccacgctgcaggcacgaaggcgccagagcgtcctgaacctgatgacacacagcgtgaaccaaggccagaacatccaccgaaagacaaccgcaagcacaaggaaggtgagcctggccccacaggcaaacctgaccgaactggacatctacagcagaaggctgagccaggagaccggcctggagatcagcgaagagatcaacgaagaggacctgaaggagtgcttcttcgacgacatggagagcataccagcagtgaccacatggaacacatacctgaggtacatcaccgtccacaagagcctgatcttcgtgctaatctggtgcctggtgatcttcctggcagaggtggccgccagcctggtggtgctgtggctcctgggaaacaccccactgcaagacaaagggaacagcacccacagcaggaacaacagctacgcagtgatcatcaccagcaccagcagctactacgtgttctacatctacgtgggagtagccgacaccctgctggccatgggattcttcagaggcctaccactggtgcacaccctaatcacagtgagcaagatcctgcaccacaagatgctgcacagcgtgctgcaagcacccatgagcaccctcaacacgctgaaggcaggcgggatcctgaacaggttcagcaaggacatagccatcctggacgacctgctgcccctgaccatcttcgacttcatccagctgctgctgatcgtgatcggagccatagcagtggtcgcagtgctgcaaccctacatcttcgtggcaacagtgccagtgatagtggccttcatcatgctgagagcatacttcctccaaaccagccagcaactcaagcagctggaaagcgaaggcaggagcccaatcttcacccacctggtgacaagcctgaagggactctggacactgagggccttcggacggcagccctacttcgaaaccctgttccacaaagccctgaacctgcacaccgccaactggttcctgtacctgagcacactgcgctggttccaaatgagaatagaaatgatcttcgtcatcttcttcatcgccgtgaccttcatcagcatcctgacaacaggagaaggagaaggaagagtgggcatcatcctgaccctggccatgaacatcatgagcacactgcagtgggccgtgaacagcagcatagacgtggacagcctgatgcgaagcgtgagccgagtcttcaagttcatcgacatgcccaccgagggcaagcccaccaagagcaccaagccctacaagaacggccaactcagcaaggtgatgatcatcgagaacagccacgtgaagaaagacgacatctggcccagcgggggccaaatgaccgtcaaagacctcacagccaagtacacagaaggcggaaacgccatcctggagaacatcagcttcagcatcagccccggccagagggtgggcctcctgggaagaaccggaagcggcaagagcaccctgctgagcgccttcctgagactactgaacaccgaaggcgagatccagatcgacggcgtgagctgggacagcatcaccctgcaacagtggaggaaggccttcggcgtgataccacagaaggtgttcatcttcagcggaaccttcaggaagaacctggacccctacgaacagtggagcgaccaggagatctggaaggtggcagacgaggtggggctcagaagcgtgatagaacagttccccgggaagctggacttcgtcctggtggacgggggctgcgtcctaagccacggccacaagcagctgatgtgcctggccagaagcgtgctcagcaaggcgaagatcctgctgctggacgaacccagcgcccacctggacccagtaacataccagatcatccggagaaccctgaagcaggcattcgccgactgcacagtaatcctctgcgaacacaggatagaagcaatgctggaatgccaacagttcctggtcatcgaagagaacaaggtgcggcagtacgacagcatccagaagctgctgaacgagaggagcctcttccggcaagccatcagccccagcgacagggtgaagctgttcccccaccggaacagcagcaagtgcaagagcaagccccagatcgccgccctgaaggaagagaccgaggaagaggtgcaggacaccaggctgtga

SEQ ID NO: 14 - DNA, 4443 bp, synthetic construct; identical to SEQ ID NO: 12
  misc_feature 1..4443: note = Synthetic construct
  source 1..4443: mol_type = other DNA

SEQ ID NO: 15 - DNA, 4443 bp, synthetic construct
  misc_feature 1..4443: note = Synthetic construct
  source 1..4443: mol_type = other DNA
atgcagaggagccccctggagaaggccagcgtggtgagcaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagccgcgtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagcgcgccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggcgagctggagcccagcgagggcaagatcaagcacagcggaagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggcggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcaccgcttcagcctggagggcgacgcccccgtgagctggaccgagaccaagaagcagagcttcaagcagaccggagagttcggcgagaagaggaagaacagcatcctgaaccccatcaacagcatcaggaagttcagcatcgtgcagaagaccccactgcagatgaacggcatcgaggaggacagcgacgagcccctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagcgcgtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccccagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggaccccgtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagcttttcccccaccggaacagcagcaagtgcaagagcaagccccagatcgccgccctgaaggaggagaccgaggaggaggtgcaggacaccaggctgtag

SEQ ID NO: 16 - DNA, 4443 bp, synthetic construct
  misc_feature 1..4443: note = Synthetic construct
  source 1..4443: mol_type = other DNA
atgcagcgcagccccctggagaaggccagcgtggtgagcaagctgttcttcagctggacccgccccatcctgcgcaagggctacagacagcgcctggagctgagcgacatctaccagatcccttctgtggacagcgccgacaacctgagcgagaagctggagcgcgagtgggaccgcgagctggccagcaagaagaaccctaagctgatcaacgccctgcgccgctgcttcttctggcgcttcatgttctacggcatcttcctgtacctgggggaggtgaccaaggccgtgcagcccctgctgctgggccgcatcatcgccagctacgaccccgacaacaaggaggagcgcagcatcgccatctacctgggcatcggcctgtgcctgctgttcatcgtgcgcaccctgctgctgcaccccgccatcttcggcctgcaccacatcggcatgcagatgcgcatcgccatgttcagcctgatctacaagaagaccctgaagctgtcaagcagggtgctggacaagatcagcatcggccagctggtgagcctgctgagcaacaacctgaacaagttcgacgagggcctggccctggcccacttcgtgtggatcgctcccctgcaggtggccctgctgatgggcctgatctgggagctgctgcaggccagcgccttctgcggcctgggcttcctgatcgtgctggccctgttccaggccggcctgggccgcatgatgatgaagtacagagaccagcgcgccggcaagatcagcgagcgcctggtgatcaccagcgagatgatcgagaacatccagagcgtgaaggcctactgctgggaggaggccatggagaagatgatcgagaacctgcgccagaccgagctgaagctgacccgcaaggccgcctacgtgcgctacttcaacagcagcgccttcttcttctcaggcttcttcgtggtgttcctgagcgtgctgccctacgccctgatcaagggcatcatcctgcgcaagatcttcaccaccatcagcttctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggcttcggcgagctgttcgagaaggccaagcagaacaacaacaaccgcaagaccagcaacggcgacgacagcctgttcttcagcaacttcagcctgctgggcacccccgtgctgaaggacatcaacttcaagatcgagcgcggccagctgctggccgtggccggcagcaccggcgccggcaagacctcactgctgatggtgatcatgggcgagctggagcctagcgagggcaagatcaagcacagcggccgcatctcattctgcagccagttcagctggatcatgcccggcaccatcaaggagaacatcatcttcggtgtgagctacgacgagtaccgctaccgcagcgtgatcaaggcctgccagctggaggaggacatcagcaagttcgccgagaaggacaacatcgtgctgggagagggtggcatcaccctgagcggcggccagagggcccgcatcagcctggcccgcgccgtgtacaaggacgccgacctgtacctgctggacagccccttcggatacctggacgtgctgaccgagaaggagatcttcgagagctgcgtgtgcaagctgatggccaacaagacccgcatcctggtgacctctaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagcgccgcaacagcatcctgaccgagaccctgcaccgcttcagcctggagggcgacgcccccgtgagctggaccgagaccaagaagcagtctttcaagcagaccggcgagttcggcgagaagcgcaagaacagcatcctgaaccccatcaacagcatccgcaagttcagcatcgtgcagaagaccccactgcagatgaacggcatcgaggaggacagcgacgagcccctggagcgccgcctgagcctggtgcccgacagcgagcagggcgaggccatcctgcctcgcatcagcgtgatcagcaccggccccaccctgcaggcccgccgccgccagagcgtgctgaacctgatgacccacagcgtgaaccagggccagaacatccacaggaagaccaccgccagcaccaggaaagtgagcctggcccctcaggccaacctgaccgagctggacatctacagccgcaggctgagccaggagaccggcctggagatcagcgaggagatcaacgaggaggacctgaaggagtgcttcttcgacgacatggagagcatccccgccgtgaccacctggaacacctacctgcgctacatcaccgtgcacaagagcctgatcttcgtgctgatctggtgcctggtgatcttcctggccgaggtggccgccagcctggtggtgctgtggctgctgggcaacacccctctgcaggacaagggcaacagcacccacagccgcaacaacagctacgccgtgatcatcaccagcaccagcagctactacgtgttctacatctacgtgggagtggccgacaccctgctggccatgggcttcttccgcggcctgcccctggtgcacaccctgatcaccgtgagcaagatcctgcaccacaagatgctgcacagcgtgctgcaggcccccatgagcaccctgaacaccctgaaggccggtggcatcctgaaccgcttcagcaaggacatcgccatcctggacgacctgctgcccctgaccatcttcgacttcatccagctgctgctgatcgtgatcggcgccatcgccgtggtggccgtgctgcagccctacatcttcgtggccaccgtgcccgtgatcgtggccttcatcatgctgcgcgcctacttcctgcagaccagccagcagctgaagcagctggagagcgagggccgcagccccatcttcacccacctggtgaccagcctgaagggcctgtggaccctgcgcgccttcggccggcagccctacttcgagaccctgttccacaaggccctgaacctgcacaccgccaactggttcctgtacctgagcaccctgcgctggttccagatgcgcatcgagatgatcttcgtgatcttcttcatcgccgtgaccttcatcagcatcctgaccaccggcgagggcgagggacgcgtgggcatcatcctgaccctggccatgaacatcatgagcaccctgcagtgggccgtgaacagcagcatcgacgtggacagcctgatgaggagcgtgagcagggtgttcaagttcatcgacatgcccaccgagggcaagcctaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttctcaatcagccccggccagcgcgtgggcctgctgggccgcaccggctcaggcaagagcaccctgctgagcgccttcctgcgcctgctgaacaccgagggcgagatccagatcgacggcgtgagctgggacagcatcaccctgcagcagtggcgcaaggccttcggcgtgatcccccagaaggtgttcatcttctctggcaccttccgcaagaacctggacccctacgagcagtggagcgaccaggagatctggaaggtggccgacgaggtgggcctgcgcagcgtgatcgagcagttccccggcaagctggacttcgtgctggtggacgggggctgcgtgctgagccacggccacaagcagctgatgtgcctggcccgcagcgtgctgagcaaggccaagatcctgctgctggacgagcccagcgcccacctggaccccgtgacctaccagatcatccgccgcaccctgaagcaggccttcgccgactgcaccgtgatcctgtgcgagcaccgcatcgaggccatgctggagtgccagcagttcctggtgatcgaggagaacaaggtgcgccagtacgactccatccagaagctgctgaacgagcgcagcctgttccgccaggccatcagccccagcgaccgcgtgaagcttttcccccaccgcaacagcagcaagtgcaagtctaagccccagatcgccgccctgaaggaggagaccgaggaggaggtgcaggacacccgcctgtag

SEQ ID NO: 17 - DNA, 4443 bp, synthetic construct
  misc_feature 1..4443: note = Synthetic construct
  source 1..4443: mol_type = other DNA
atgcagaggtcgcctctggagaaggccagcgtggtgtccaagctgttcttcagctggaccagacccatcctgaggaagggctaccgccagcgcctggagctgagcgacatctaccagatccccagcgtggacagcgctgacaacctgagcgagaagctggagagagagtgggaccgcgagctggccagcaagaagaaccctaagctgatcaacgccctgcggcgctgcttcttctggcgcttcatgttctacggcatcttcctgtacctgggcgaggtgaccaaggccgtgcagcccctgctgctgggccgcatcatcgccagctacgaccccgacaacaaggaggagcgctctatcgccatctacctgggcatcggcctgtgcctgctgttcatcgtgcgcaccctgctgctgcaccccgccatcttcggcctgcaccacatcggcatgcagatgcgcatcgccatgttcagcctgatctacaagaagaccctgaagctgagcagccgcgtgctggacaagatcagtatcggccagctggtgagcctgctgtccaacaacctgaacaagttcgacgagggcctggccctggcccacttcgtgtggatcgcccctctgcaggtggccctgctgatggggctgatctgggagctgctgcaggccagcgccttctgcggcctgggcttcctgatcgtgctggccctgttccaggccggcctgggcagaatgatgatgaagtaccgcgaccagcgcgccggcaagatcagcgagagactggtgatcaccagcgagatgatcgagaacatccagtctgtgaaggcctactgctgggaggaggccatggagaagatgatcgagaacctgcgccagaccgagctgaagctgacccggaaggccgcctacgtgcgctacttcaacagcagcgccttcttcttctcaggcttcttcgtggtgttcctgagcgtgctgccctacgccctgatcaagggcatcatcctgcggaagatcttcaccaccatcagcttctgcatcgtgctgcgcatggccgtgacccgccagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagggcttcggcgagctgttcgagaaggccaagcagaacaacaacaacagaaagaccagcaacggcgacgacagcctgttcttcagcaacttcagcctgctgggcacccccgtgctgaaggacatcaacttcaagatcgagcgcggccagctgctggccgtggccggcagcaccggcgccggcaagaccagcctgctgatggtgatcatgggcgagctggagcccagcgagggcaagatcaagcacagcggacgcatcagcttctgcagccagttctcctggatcatgcctggcaccatcaaggagaacatcatcttcggcgtgagctacgacgagtaccgctaccgcagcgtgatcaaggcctgccagctggaggaggacatcagcaagttcgccgagaaggacaacatcgtgctgggagagggcggcatcaccctgagcggcggccagagggcccgcatcagcctggcaagagcagtgtacaaggacgccgacctgtacctgctggacagccccttcggctacctggacgtgctgaccgagaaggagatcttcgagagctgcgtgtgcaagctgatggccaacaagacccgcatcctggtgaccagcaagatggagcacctgaagaaggctgacaagatcctgatcctgcacgagggcagcagctacttctacggcaccttcagcgagctgcagaacctgcagccagacttcagcagcaagctgatgggctgcgacagcttcgaccagttcagcgccgagagaagaaacagcatcctgaccgagaccctgcaccgcttcagcctggagggcgacgcccccgtgtcctggaccgagaccaagaagcagagcttcaagcagaccggcgagttcggcgagaagcgcaagaactctatcctgaaccccatcaacagcatccgcaagttcagcatcgtgcagaagaccccactgcagatgaacggcatcgaggaggacagcgacgagcccctggagcgccgcctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcacccgcaaagtgagcctggccccacaggccaacctgaccgagctggacatctacagccgccgcctgtctcaggagaccggcctggagatcagcgaggagatcaacgaggaggacctgaaggagtgcttcttcgacgacatggagagcatccccgccgtgaccacctggaacacctacctgcgctacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagccgcaacaacagctacgccgtgatcatcaccagcaccagcagctactacgtgttctacatctacgtgggcgtggccgacaccctgctggccatgggcttcttcagaggcctgcccctggtgcacaccctgatcaccgtgagcaagatcctgcaccacaagatgctgcacagcgtgctgcaggcccccatgagcaccctgaacaccctgaaggccggcggcatcctgaaccgcttcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagtctgagggcaggagccccatcttcacccacctggtgaccagcctgaagggcctgtggaccctgagggccttcggccggcagccttacttcgagaccctgttccacaaggccctgaacctgcacaccgccaactggttcctgtacctgagcaccctgcgctggttccagatgcgcatcgagatgatcttcgtgatcttcttcatcgccgtgaccttcatcagcatcctgaccaccggcgagggagagggcagagtgggcatcatcctgaccctggccatgaacatcatgagcaccctgcagtgggctgtgaacagcagcatcgacgtggacagcctgatgcgcagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttctcaatcagccccggccagcgcgtgggcctgctgggacgcaccggcagcggcaagagcaccctgctgagcgccttcctgagactgctgaacaccgagggcgagatccagatcgacggcgtgagctgggactcaatcaccctgcagcagtggaggaaggccttcggcgtgatcccccagaaggtgttcatcttcagcggcaccttccgcaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggcccgctctgtgctgagcaaggccaagatcctgctgctggacgagcccagtgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcgccagtacgacagcatccagaagctgctgaacgagaggagcctgttccgccaggccatcagccccagcgacagggtgaagcttttcccccaccgcaacagcagcaagtgcaagagcaagccccagatcgccgccctgaaggaggagaccgaggaggaggtgcaggacaccaggctgtag

SEQ ID NO: 18 - DNA, 4443 bp, synthetic construct
  misc_feature 1..4443: note = Synthetic construct
  source 1..4443: mol_type = other DNA
atgcagcgcagccccctggagaaggccagcgtggtgtccaagctgttcttcagctggacccgccccatcctgaggaagggctaccgccagcgcctggagctgagcgacatctaccagatccctagcgtggacagcgccgacaacctgagcgagaagctggagcgcgagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggccgcatcatcgcctcctacgaccccgacaacaaggaggagcgcagcatcgccatctacctgggcatcggcctgtgcctgctgttcatcgtgcgcaccctgctgctgcaccccgccatcttcggcctgcaccacatcggcatgcagatgcgcatcgccatgttcagcctgatctacaagaagaccctgaagctgagcagccgcgtgctggacaagatcagcatcggccagctggtgagcctgctgtccaacaacctgaacaagttcgacgagggactggccctggcccacttcgtgtggatcgcccctctgcaggtggccctgctgatggggctgatctgggagctgctgcaggccagcgccttctgcggcctgggcttcctgatcgtgctggccctgttccaggccggcctgggcagaatgatgatgaagtaccgcgaccagcgcgccggcaagatcagcgagcgcctggtgatcaccagcgagatgatcgagaacatccagagcgtgaaggcctactgctgggaggaggccatggagaagatgatcgagaacctgagacagaccgagctgaagctgacccgcaaggccgcctacgtgagatacttcaacagcagcgccttcttcttcagcggcttcttcgtggtgttcctgtctgtgctgccctacgccctgatcaagggcatcatcctgcgcaagatcttcaccaccatctcattctgcatcgtgctgcgcatggccgtgacccggcagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaaccgcaagaccagcaacggcgacgacagcctgttcttcagcaacttcagcctgctgggcacccctgtgctgaaggacatcaacttcaagatcgagcgcggccagctgctggccgtggccggcagcaccggcgccggcaagaccagcctgctgatggtgatcatgggagagctggagcctagcgagggcaagatcaagcacagtggacgcatcagcttctgcagccagttctcctggatcatgcctggcaccatcaaggagaacatcatcttcggcgtgtcctacgacgagtaccgctacagaagcgtgatcaaggcctgccagctggaggaggacatcagcaagttcgccgagaaggacaacatcgtgctgggagagggcggcatcaccctgagcggaggccagcgcgccagaatcagcctggccagagccgtgtacaaggacgccgacctgtacctgctggacagccccttcggctacctggacgtgctgaccgagaaggagatcttcgagagctgcgtgtgcaagctgatggccaacaagaccaggatcctggtgacctctaagatggagcacctgaagaaggccgacaagatcctgatcctgcacgagggcagcagctacttctacggcaccttcagcgagctgcagaacctgcagccagacttcagcagcaagctgatgggctgcgacagcttcgaccagttcagcgccgagcgccgcaacagcatcctgaccgagaccctgcaccgcttcagcctggagggcgacgcccccgtgagctggaccgagaccaagaagcagagcttcaagcagaccggagagttcggcgagaagaggaagaacagcatcctgaaccccatcaacagcatcaggaagttctccatcgtgcagaagaccccactgcagatgaacggcatcgaggaggacagcgacgagcccctggagcgccgcctgagcctggtgccagacagcgagcagggcgaggccatcctgccccgcatcagcgtgatcagcaccggccccaccctgcaggcccgcaggaggcagagcgtgctgaacctgatgacccacagcgtgaaccagggccagaacatccacaggaagaccaccgcctccacccgcaaagtgagcctggccccacaggccaacctgaccgagctggacatctacagccgccgcctgagccaggagaccggcctggagatcagcgaggagatcaacgaggaggacctgaaggagtgcttcttcgacgacatggagagcatcccagccgtgaccacctggaacacctacctgcgctacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagccgcaacaacagctacgccgtgatcatcaccagcaccagcagctactacgtgttctacatctacgtgggcgtggccgacaccctgctggccatgggcttcttccgcggcctgcccctggtgcacaccctgatcaccgtgagcaagatcctgcaccacaagatgctgcacagcgtgctgcaggcccccatgagcaccctgaacaccctgaaggccggtggcatcctgaaccgcttcagcaaggacatcgccatcctggacgacctgctgcccctgaccatcttcgacttcatccagctgctgctgatcgtgatcggcgccatcgccgtggtggccgtgctgcagccctacatcttcgtggccaccgtgcccgtgatcgtggccttcatcatgctgagagcctacttcctgcagaccagccagcagctgaagcagctggagagcgagggccgcagtccaatcttcacccacctggtgaccagcctgaagggcctgtggaccctgcgcgccttcggccgccagccctacttcgagaccctgttccacaaggctctgaacctgcacaccgccaactggttcctgtacctgagcaccctgcgctggttccagatgcgcatcgagatgatcttcgtgatcttcttcatcgccgtgaccttcatcagcatcctgaccaccggcgagggagagggcagagtgggcatcatcctgaccctggccatgaacatcatgagcaccctgcagtgggccgtgaactccagcatcgacgtggacagcctgatgaggtctgtgagccgcgtgttcaagttcatcgacatgccaaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttctcaatcagccccggccagcgcgtgggcctgctgggacgcaccggcagcggcaagagcaccctgctgagcgccttcctgagactgctgaacaccgagggcgagatccagatcgacggcgtgtcttgggactcaatcaccctgcagcagtggcgcaaggccttcggcgtgatcccccagaaggtgttcatcttcagcggaaccttcagaaagaacctggacccctacgagcagtggagcgaccaggagatctggaaggtggccgacgaggtgggcctgcgcagcgtgatcgagcagttccccggcaagctggacttcgtgctggtggacggcggctgcgtgctgagccacggccacaagcagctgatgtgcctggccagaagcgtgctgagcaaggccaagatcctgctgctggacgagcccagcgcccacctggaccccgtgacctaccagatcatccgcagaaccctgaagcaggccttcgccgactgcaccgtgatcctgtgcgagcaccgcatcgaggccatgctggagtgccagcagttcctggtgatcgaggagaacaaggtgcgccagtacgacagcatccagaagctgctgaacgagcgcagcctgttccgccaggccatcagccccagcgaccgcgtgaagcttttcccccaccgcaacagcagcaagtgcaagtctaagccccagatcgccgccctgaaggaggagaccgaggaggaggtgcaggacaccaggctgtag

SEQ ID NO: 19 - DNA, 4443 bp, synthetic construct
  misc_feature 1..4443: note = Synthetic construct
  source 1..4443: mol_type = other DNA
atgcagcgcagccccctggagaaggccagcgtggtgagcaagctgttcttcagctggacccgcccaatcctgcgcaagggctaccgccagcgcctggagctgagcgacatctaccagatccccagcgtggacagcgccgacaacctgagcgagaagctggagagagagtgggaccgcgagctggccagcaagaagaaccctaagctgatcaacgccctgcggcgctgcttcttctggcgcttcatgttctacggcatcttcctgtacctgggcgaggtgaccaaggccgtgcagcccctgctgctgggccgcatcatcgcctcctacgaccccgacaacaaggaggagcgcagcatcgccatctacctgggcatcggcctgtgcctgctgttcatcgtgcgcaccctgctgctgcaccccgccatcttcggcctgcaccacatcggcatgcagatgcgcatcgccatgttcagcctgatctacaagaagaccctgaagctgagcagccgcgtgctggacaagatcagcatcggccagctggtgagcctgctgtccaacaacctgaacaagttcgacgagggcctggccctggcccacttcgtgtggatcgccccactgcaggtggccctgctgatggggctgatctgggagctgctgcaggcctctgccttctgcggcctgggcttcctgatcgtgctggccctgttccaggccggcctgggcagaatgatgatgaagtacagagaccagcgcgccggcaagatcagcgagcgcctggtgatcacctcagagatgatcgagaacatccagtctgtgaaggcctactgctgggaggaggccatggagaagatgatcgagaacctgcgccagaccgagctgaagctgacccgcaaggccgcctacgtgcgctacttcaacagcagcgccttcttcttctcaggcttcttcgtggtgttcctgagcgtgctgccctacgccctgatcaagggcatcatcctgcgcaagatcttcaccaccatcagcttctgcatcgtgctgcgcatggccgtgacccgccagttcccctgggccgtgcagacctggtacgactctctgggcgccatcaacaagatccaggacttcctgcagaagcaggagtacaagaccctggagtacaacctgaccaccaccgaggtggtgatggagaacgtgaccgccttctgggaggagggcttcggcgagctgttcgagaaggccaagcagaacaacaacaaccgcaagaccagcaacggcgacgacagcctgttcttcagcaacttcagcctgctgggcacccccgtgctgaaggacatcaacttcaagatcgagcgcggccagctgctggccgtggccggcagcaccggcgccggcaagaccagcctgctgatggtgatcatgggcgagctggagcctagcgagggcaagatcaagcacagcggcagaatctcattctgctctcagttcagctggatcatgcctggcaccatcaaggagaacatcatcttcggcgtgtcctacgacgagtaccgctaccgcagcgtgatcaaggcctgccagctggaggaggacatcagcaagttcgccgagaaggacaacatcgtgctgggagagggcggcatcaccctgagcggcggccagcgcgcccgcatcagcctggcccgcgccgtgtacaaggacgccgacctgtacctgctggactctcctttcggctacctggacgtgctgaccgagaaggagatcttcgagagctgcgtgtgcaagctgatggccaacaagacccgcatcctggtgaccagcaagatggagcacctgaagaaggccgacaagatcctgatcctgcacgagggcagcagctacttctacggcaccttcagcgagctgcagaacctgcagccagacttcagcagcaagctgatgggctgcgacagcttcgaccagttcagcgccgagcgccgcaacagcatcctgaccgagaccctgcaccgcttcagcctggagggcgacgcccccgtgagctggaccgagaccaagaagcagtctttcaagcagaccggcgagttcggcgagaagaggaagaacagcatcctgaacccaatcaacagcatccgcaagttcagcatcgtgcagaagaccccactgcagatgaacggcatcgaggaggacagcgacgagcctctggagcgccgcctgtccctggtgcccgacagcgagcagggcgaggccatcctgccccgcatcagcgtgatcagcaccggccccaccctgcaggcccgccgccgccagagcgtgctgaacctgatgacccacagcgtgaaccagggccagaacatccaccgcaagaccaccgccagcacccgcaaagtgagcctggccccacaggccaacctgaccgagctggacatctacagcagacgcctgagccaggagaccggcctggagatcagcgaggagatcaacgaggaggacctgaaggagtgcttcttcgacgacatggagagcatcccagccgtgaccacctggaacacctacctgcgctacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagccgcaacaacagctacgccgtgatcatcaccagcaccagcagctactacgtgttctacatctacgtgggcgtggccgacaccctgctggccatgggcttcttccgcggcctgcccctggtgcacaccctgatcaccgtgagcaagatcctgcaccacaagatgctgcacagcgtgctgcaggcccccatgagcaccctgaacaccctgaaggccggtggcatcctgaaccgcttcagcaaggacatcgccatcctggacgacctgctgcccctgaccatcttcgacttcatccagctgctgctgatcgtgatcggcgccatcgccgtggtggccgtgctgcagccctacatcttcgtggccaccgtgccagtgatcgtggccttcatcatgctgcgcgcctacttcctgcagaccagccagcagctgaagcagctggagagcgagggccgcagccccatcttcacccacctggtgaccagcctgaagggcctgtggaccctgcgcgccttcggccgccagccttacttcgagaccctgttccacaaggctctgaacctgcacaccgccaactggttcctgtacctgagcaccctgcgctggttccagatgcgcatcgagatgatcttcgtgatcttcttcatcgccgtgaccttcatcagcatcctgaccaccggcgagggcgagggccgcgtgggcatcatcctgaccctggccatgaacatcatgagcaccctgcagtgggccgtgaacagcagcatcgacgtggacagcctgatgcgcagcgtgagccgcgtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatctccttcagcatcagccccggccagcgcgtgggcctgctgggccgcaccggcagcggcaagagcaccctgctgagcgccttcctgcgcctgctgaacaccgagggcgagatccagatcgacggcgtgtcttgggacagcatcaccctgcagcagtggcgcaaggccttcggcgtgatcccccagaaggtgttcatcttcagcggcaccttccgcaagaacctggacccctacgagcagtggagcgaccaggagatctggaaggtggccgacgaggtgggcctgcgcagcgtgatcgagcagttccccggcaagctggacttcgtgctggtggacggcggctgcgtgctgagccacggccacaagcagctgatgtgcctggcccgcagcgtgctgagcaaggccaagatcctgctgctggacgagcccagcgcccacctggaccccgtgacctaccagatcatccgccgcaccctgaagcaggccttcgccgactgcaccgtgatcctgtgcgagcaccgcatcgaggccatgctggagtgccagcagttcctggtgatcgaggagaacaaggtgcggcagtacgacagcatccagaagctgctgaacgagaggagcctgttccgccaggccatcagccccagcgaccgcgtgaagcttttcccccaccgcaacagcagcaagtgcaagagcaagccccagatcgccgccctgaaggaggagaccgaggaggaggtgcaggacaccaggctgtag

SEQ ID NO: 20 - DNA, 4443 bp, synthetic construct
  misc_feature 1..4443: note = Synthetic construct
  source 1..4443: mol_type = other DNA
atgcagaggtcgcccctggagaaggctagcgtggtgagcaagctgttcttcagctggaccagaccaatcctgaggaagggctacagacagcgcctggagctgtcagacatctaccagatccctagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagtatcggacagctggtgagcctgctgagcaacaacctgaacaagttcgacgagggactggccctggcccacttcgtgtggatcgcccctctgcaggtggccctgctgatggggctgatctgggagctgctgcaggccagcgccttctgcggcctgggcttcctgatcgtgctggccctgttccaggccggcctgggcagaatgatgatgaagtacagagaccagagagctggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttctcctggatcatgcccggcaccatcaaggagaacatcatcttcggtgtgagctacgacgagtacagatacagaagcgtgatcaaggcctgccagctggaggaggacatctccaagttcgcagagaaggacaacatcgtgctgggagagggtggcatcaccctgagcggaggccagagggccagaatctctctggcaagagcagtgtacaaggacgccgacctgtacctgctggactctcccttcggatacctggacgtgctgaccgagaaggagatcttcgagagctgcgtgtgcaagctgatggccaacaagaccaggatcctggtgacctctaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagagcttcaagcagaccggagagttcggcgagaagaggaagaacagcatcctgaacccaatcaacagcatcaggaagttctccatcgtgcagaagaccccactgcagatgaacggcatcgaggaggacagcgacgagcccctggagagaaggctgagcctggtgccagactctgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggtgggatcctgaacagattctccaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagtctgagggcaggagtccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggactcaatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagatctgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtag

SEQ ID NO: 21 - DNA, 4443 bp, synthetic construct
  misc_feature 1..4443: note = Synthetic construct
  source 1..4443: mol_type = other DNA
atgcagaggagccccctggagaaggctagcgtggtgagcaagctgttcttcagctggaccagaccaatcctgaggaagggctacagacagcgcctggagctgtcagacatctaccagatccccagcgtggactctgccgacaacctgtctgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagctggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccctgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttcagctggatcatgcccggcaccatcaaggagaacatcatcttcggtgtgtcctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgctgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgtcctggaccgagaccaagaagcagtctttcaagcagaccggagagttcggcgagaagaggaagaacagcatcctgaacccaatcaactctatcaggaagttcagcatcgtgcagaagaccccactgcagatgaacggcatcgaggaggacagcgacgagcccctggagagaaggctgagcctggtgccagacagcgagcagggcgaggccatcctgcctcgcatcagcgtgatcagcaccggccccaccctgcaggccaggaggaggcagtctgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggtgggatcctgaacagattctccaaggacatcgccatcctggacgacctgctgcctctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaactccagcatcgacgtggacagcctgatgaggagcgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccctggcaagctggacttcgtgctggtggacgggggctgcgtgctgagccacggccacaagcagctgatgtgcctggccagatctgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtag

SEQ ID NO: 22 - DNA, 4443 bp, synthetic construct
  misc_feature 1..4443: note = Synthetic construct
  source 1..4443: mol_type = other DNA
atgcagaggtcgcccctggagaaggctagcgtggtgtccaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcctctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagcatcggacagctggtgagtctgctgagcaacaacctgaacaagttcgacgagggactggccctggcccacttcgtgtggatcgctccactgcaggtggccctgctgatggggctgatctgggagctgctgcaggccagcgccttctgcggcctgggcttcctgatcgtgctggccctgttccaggccggcctgggcagaatgatgatgaagtacagagaccagagagctggcaagatcagcgagagactggtgatcacctcagagatgatcgagaacatccagtctgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccccgtgctgaaggacatcaacttcaagatcgagagaggacagctgctggccgtggccggatccaccggagccggcaagaccagcctgctgatggtgatcatgggagagctggagccctcagagggcaagatcaagcacagtggaagaatctcattctgcagccagttctcctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagtctttcaagcagaccggagagttcggcgagaagaggaagaacagcatcctgaacccaatcaacagcatcaggaagttcagcatcgtgcagaagaccccactgcagatgaacggcatcgaggaggacagcgacgagcctctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggcccctcaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccctatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagtccaatcttcacccacctggtgaccagcctgaagggactgtggaccctgagggccttcggccggcagccttacttcgagaccctgttccacaaggccctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggctcaggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagcccctccgacagggtgaagctgttcccccaccggaacagcagcaagtgcaagagcaagccccagatcgccgccctgaaggaggagaccgaggaggaggtgcaggacaccaggctgtag

SEQ ID NO: 23 - DNA, 4443 bp, synthetic construct
  misc_feature 1..4443: note = Synthetic construct
  source 1..4443: mol_type = other DNA
atgcagaggtcgcccctggagaaggctagcgtggtgagcaagctgttcttcagctggaccagaccaatcctgaggaagggctacagacagcgcctggagctgagcgacatctaccagatccctagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcctctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagtatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcacctcagagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccctgtgctgaaggacatcaacttcaagatcgagagaggacagctgctggccgtggccggaagcaccggagccggcaagaccagcctgctgatggtgatcatgggagagctggagccctcagagggcaagatcaagcacagcggaagaatcagcttctgcagccagttcagctggatcatgcccggcaccatcaaggagaacatcatcttcggtgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatctctctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgtcctggaccgagaccaagaagcagagcttcaagcagaccggagagttcggcgagaagaggaagaacagcatcctgaacccaatcaactctatcaggaagttcagcatcgtgcagaagaccccactgcagatgaacggcatcgaggaggacagcgacgagcccctggagagaaggctgtccctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgcctctctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccctatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggctctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggctgtgaacagcagcatcgacgtggacagcctgatgaggagcgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttctcaatcagccctggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccctggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagtctaagccccagatcgccgccctgaaggaggagaccgaggaggaggtgcaggacaccaggctgtag

SEQ ID NO: 24 - DNA, 4443 bp, synthetic construct
  misc_feature 1..4443: note = Synthetic construct
  source 1..4443: mol_type = other DNA
atgcagaggagccccctggagaaggccagcgtggtgagcaagctgttcttcagctggaccagaccaatcctgcgcaagggctaccgccagcgcctggagctgagcgacatctaccagatccccagcgtggacagcgccgacaacctgagcgagaagctggagagagagtgggacagagagctggccagcaagaagaaccccaagctgatcaacgccctgcgcaggtgcttcttctggagattcatgttctacggaatcttcctgtacctgggcgaggtgaccaaggccgtgcagcccctgctgctgggaagaatcatcgccagctacgaccccgacaacaaggaggagcgcagcatcgccatctacctgggcatcggcctgtgcctgctgttcatcgtgcgcaccctgctgctgcacccagccatcttcggcctgcaccacatcggaatgcagatgcgcatcgccatgttcagcctgatctacaagaagaccctgaagctgagcagccgcgtgctggacaagatcagcatcggacagctggtgagcctgctgagcaacaacctgaacaagttcgacgagggactggccctggcccacttcgtgtggatcgccccactgcaggtggccctgctgatgggcctgatctgggagctgctgcaggccagcgccttctgcggcctgggcttcctgatcgtgctggccctgttccaggccggcctgggcagaatgatgatgaagtacagagaccagcgcgccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgcgctacttcaacagcagcgccttcttcttcagcgggttcttcgtggtgttcctgagcgtgctgccctacgccctgatcaagggcatcatcctgcgcaagatcttcaccaccatcagcttctgcatcgtgctgcgcatggccgtgacccgccagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaaccgcaagaccagcaacggcgacgacagcctgttcttcagcaacttcagcctgctgggcacccccgtgctgaaggacatcaacttcaagatcgagcgcggacagctgctggccgtggccggaagcaccggagccggcaagaccagcctgctgatggtgatcatgggcgagctggagcccagcgagggcaagatcaagcacagcggacgcatcagcttctgcagccagttcagctggatcatgcccggcaccatcaaggagaacatcatcttcggcgtgagctacgacgagtacagataccgcagcgtgatcaaggcctgccagctggaggaggacatcagcaagttcgcagagaaggacaacatcgtgctgggcgagggcggcatcaccctgagcggcggccagagggccagaatcagcctggcacgcgcagtgtacaaggacgccgacctgtacctgctggacagccccttcggctacctggacgtgctgaccgagaaggagatcttcgagagctgcgtgtgcaagctgatggccaacaagacccgcatcctggtgaccagcaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagagaagaaacagcatcctgaccgagaccctgcaccgcttcagcctggagggcgacgcccccgtgagctggaccgagaccaagaagcagagcttcaagcagaccggcgagttcggcgagaagcgcaagaacagcatcctgaaccccatcaacagcatcaggaagttcagcatcgtgcagaagaccccactgcagatgaacggcatcgaggaggacagcgacgagcccctggagcgcaggctgagcctggtgccagacagcgagcagggcgaggccatcctgccccgcatcagcgtgatcagcaccggccccaccctgcaggccaggcgccgccagagcgtgctgaacctgatgacccacagcgtgaaccagggccagaacatccacaggaagaccaccgccagcaccaggaaggtgagcctggccccacaggccaacctgaccgagctggacatctacagcagacgcctgagccaggagaccggcctggagatcagcgaggagatcaacgaggaggacctgaaggagtgcttcttcgacgacatggagagcatcccagccgtgaccacctggaacacctacctgcgctacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggcgccatcgccgtggtggccgtgctgcagccctacatcttcgtggccaccgtgccagtgatcgtggccttcatcatgctgagagcctacttcctgcagaccagccagcagctgaagcagctggagagcgagggccgcagccccatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggcgagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagcgcgtgggcctgctgggacgcaccggcagcggcaagagcaccctgctgagcgccttcctgagactgctgaacaccgagggcgagatccagatcgacggcgtgagctgggacagcatcaccctgcagcagtggaggaaggccttcggcgtgatcccccagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggaccccgtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgaccgcgtgaagcttttcccccaccgcaacagcagcaagtgcaagagcaagccccagatcgccgccctgaaggaggagaccgaggaggaggtgcaggacaccaggctgtag

SEQ ID NO: 25 - DNA, 4443 bp, synthetic construct
  misc_feature 1..4443: note = Synthetic construct
  source 1..4443: mol_type = other DNA
atgcagcgcagccccctggagaaggccagcgtggtgagcaagctgttcttcagctggacccgccccatcctgcgcaagggctaccgccagcgcctggagctgagcgacatctaccagatccccagcgtggacagcgccgacaacctgagcgagaagctggagcgcgagtgggacagagagctggccagcaagaagaaccccaagctgatcaacgccctgcgcaggtgcttcttctggcgcttcatgttctacggaatcttcctgtacctgggcgaggtgaccaaggccgtgcagcccctgctgctgggccgcatcatcgccagctacgaccccgacaacaaggaggagcgcagcatcgccatctacctgggcatcggcctgtgcctgctgttcatcgtgcgcaccctgctgctgcaccccgccatcttcggcctgcaccacatcggaatgcagatgcgcatcgccatgttcagcctgatctacaagaagaccctgaagctgagcagccgcgtgctggacaagatcagcatcggccagctggtgagcctgctgagcaacaacctgaacaagttcgacgagggactggccctggcccacttcgtgtggatcgccccactgcaggtggccctgctgatgggcctgatctgggagctgctgcaggccagcgccttctgcggcctgggcttcctgatcgtgctggccctgttccaggccggcctgggccgcatgatgatgaagtaccgcgaccagcgcgccggcaagatcagcgagagactggtgatcaccagcgagatgatcgagaacatccagagcgtgaaggcctactgctgggaggaggccatggagaagatgatcgagaacctgagacagaccgagctgaagctgacccggaaggccgcctacgtgcgctacttcaacagcagcgccttcttcttcagcggcttcttcgtggtgttcctgagcgtgctgccctacgccctgatcaagggcatcatcctgcgcaagatcttcaccaccatcagcttctgcatcgtgctgcgcatggccgtgacccgccagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaaccgcaagaccagcaacggcgacgacagcctgttcttcagcaacttcagcctgctgggcacccccgtgctgaaggacatcaacttcaagatcgagcgcggccagctgctggccgtggccggaagcaccggagccggcaagaccagcctgctgatggtgatcatgggcgagctggagcccagcgagggcaagatcaagcacagcggccgcatcagcttctgcagccagttcagctggatcatgcccggcaccatcaaggagaacatcatcttcggcgtgagctacgacgagtaccgctaccgcagcgtgatcaaggcctgccagctggaggaggacatcagcaagttcgccgagaaggacaacatcgtgctgggcgagggcggcatcaccctgagcggcggccagcgcgcccgcatcagcctggcccgcgccgtgtacaaggacgccgacctgtacctgctggacagccccttcggctacctggacgtgctgaccgagaaggagatcttcgagagctgcgtgtgcaagctgatggccaacaagacccgcatcctggtgaccagcaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagagaagaaacagcatcctgaccgagaccctgcaccgcttcagcctggagggcgacgcccccgtgagctggaccgagaccaagaagcagagcttcaagcagaccggcgagttcggcgagaagcgcaagaacagcatcctgaaccccatcaacagcatccgcaagttcagcatcgtgcagaagaccccactgcagatgaacggcatcgaggaggacagcgacgagcccctggagcgccgcctgagcctggtgcccgacagcgagcagggcgaggccatcctgccccgcatcagcgtgatcagcaccggccccaccctgcaggcccgccgccgccagagcgtgctgaacctgatgacccacagcgtgaaccagggccagaacatccaccgcaagaccaccgccagcacccgcaaagtgagcctggccccacaggccaacctgaccgagctggacatctacagcagacgcctgagccaggagaccggcctggagatcagcgaggagatcaacgaggaggacctgaaggagtgcttcttcgacgacatggagagcatcccagccgtgaccacctggaacacctacctgcgctacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggcgtggccgacaccctgctggccatgggcttcttccgcggcctgccactggtgcacaccctgatcaccgtgagcaagatcctgcaccacaagatgctgcacagcgtgctgcaggcccccatgagcaccctgaacaccctgaaggccggcgggatcctgaaccgcttcagcaaggacatcgccatcctggacgacctgctgcccctgaccatcttcgacttcatccagctgctgctgatcgtgatcggcgccatcgccgtggtggccgtgctgcagccctacatcttcgtggccaccgtgcccgtgatcgtggccttcatcatgctgagagcctacttcctgcagaccagccagcagctgaagcagctggagagcgagggccgcagccccatcttcacccacctggtgaccagcctgaagggcctgtggaccctgagggccttcggccgccagccctacttcgagaccctgttccacaaggccctgaacctgcacaccgccaactggttcctgtacctgagcaccctgcgctggttccagatgcgcatcgagatgatcttcgtgatcttcttcatcgccgtgaccttcatcagcatcctgaccaccggcgagggcgagggacgcgtgggcatcatcctgaccctggccatgaacatcatgagcaccctgcagtgggccgtgaacagcagcatcgacgtggacagcctgatgaggagcgtgagcagggtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagcgcgtgggcctgctgggccgcaccggcagcggcaagagcaccctgctgagcgccttcctgcgcctgctgaacaccgagggcgagatccagatcgacggcgtgagctgggacagcatcaccctgcagcagtggcgcaaggccttcggcgtgatcccccagaaggtgttcatcttcagcggcaccttccgcaagaacctggacccctacgagcagtggagcgaccaggagatctggaaggtggccgacgaggtgggcctgagaagcgtgatcgagcagttccccggcaagctggacttcgtgctggtggacggcggctgcgtgctgagccacggccacaagcagctgatgtgcctggcccgcagcgtgctgagcaaggccaagatcctgctgctggacgagcccagcgcccacctggaccccgtgacctaccagatcatcagacgcaccctgaagcaggccttcgccgactgcaccgtgatcctgtgcgagcacaggatcgaggccatgctggagtgccagcagttcctggtgatcgaggagaacaaggtgcgccagtacgacagcatccagaagctgctgaacgagcgcagcctgttccgccaggccatcagccccagcgaccgcgtgaagcttttcccccaccgcaacagcagcaagtgcaagagcaagccccagatcgccgccctgaaggaggagaccgaggaggaggtgcaggacacccgcctgtag

SEQ ID NO: 26 - DNA, 4443 bp, synthetic construct
  misc_feature 1..4443: note = Synthetic construct
  source 1..4443: mol_type = other DNA
atgcagaggagccccctggagaaggctagcgtggtgagcaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagagcttcaagcagaccggagagttcggcgagaagaggaagaacagcatcctgaacccaatcaacagcatcaggaagttcagcatcgtgcagaagaccccactgcagatgaacggcatcgaggaggacagcgacgagcccctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggctgtgaactccagcatcgacgtggacagcctgatgaggtctgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatctccttctcaatcagccctggccagagggtgggcctgctgggaagaaccggcagcggcaagagcaccctgctgagcgccttcctgagactgctgaacaccgagggcgagatccagatcgacggcgtgtcttgggactcaatcaccctgcagcagtggaggaaggccttcggcgtgatcccacagaaggtgttcatcttctctggaaccttcagaaagaacctggacccctacgagcagtggagcgaccaggagatctggaaggtggccgacgaggtgggcctgagatctgtgatcgagcagttccctggcaagctggacttcgtgctggtggacgggggctgcgtgctgagccacggccacaagcagctgatgtgcctggccagatctgtgctgagcaaggccaagatcctgctgctggacgagcccagtgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagcccctccgacagggtgaagctgttcccccaccggaacagcagcaagtgcaagtctaagccccagatcgccgccctgaaggaggagaccgaggaggaggtgcaggacaccaggctgtag

SEQ ID NO: 27 - DNA, 4443 bp, synthetic construct
  misc_feature 1..4443: note = Synthetic construct
  source 1..4443: mol_type = other DNA
atgcagaggagccccctggagaaggctagcgtggtgagcaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggatccaccggagccggcaagacctcactgctgatggtgatcatgggagagctggagccttcagagggcaagatcaagcacagtggaagaatcagcttctgcagccagttctcctggatcatgcccggcaccatcaaggagaacatcatcttcggtgtgtcctacgacgagtacagatacagaagcgtgatcaaggcctgccagctggaggaggacatcagcaagttcgcagagaaggacaacatcgtgctgggagagggtggcatcaccctgagcggaggccagagggccagaatctctctggcaagagcagtgtacaaggacgccgacctgtacctgctggactctcccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgtcctggaccgagaccaagaagcagtctttcaagcagaccggagagttcggcgagaagaggaagaactctatcctgaacccaatcaactctatcaggaagttctccatcgtgcagaagaccccactgcagatgaacggcatcgaggaggactctgacgagcccctggagagaaggctgtccctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtag

SEQ ID NO: 28 - DNA, 4443 bp, synthetic construct
  misc_feature 1..4443: note = Synthetic construct
  source 1..4443: mol_type = other DNA
atgcagaggagccccctggagaaggctagcgtggtgagcaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccctgtgctgaaggacatcaacttcaagatcgagagaggacagctgctggccgtggccggatccaccggagccggcaagaccagcctgctgatggtgatcatgggagagctggagcctagcgagggcaagatcaagcacagtggaagaatctcattctgctctcagttcagctggatcatgcctggcaccatcaaggagaacatcatcttcggtgtgtcctacgacgagtacagatacagaagcgtgatcaaggcctgccagctggaggaggacatcagcaagttcgcagagaaggacaacatcgtgctgggagagggtggcatcaccctgagcggaggccagagggccagaatcagcctggcaagagcagtgtacaaggacgccgacctgtacctgctggactctcctttcggatacctggacgtgctgaccgagaaggagatcttcgagagctgcgtgtgcaagctgatggccaacaagaccaggatcctggtgaccagcaagatggagcacctgaagaaggctgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccctgtgagctggaccgagaccaagaagcagtctttcaagcagaccggagagttcggcgagaagaggaagaactctatcctgaacccaatcaacagcatcaggaagttctccatcgtgcagaagaccccactgcagatgaacggcatcgaggaggacagcgacgagcctctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtag

SEQ ID NO: 29 - DNA, 4443 bp, synthetic construct
  misc_feature 1..4443: note = Synthetic construct
  source 1..4443: mol_type = other DNA
atgcagaggagccctctggagaaggctagcgtggtgtccaagctgttcttcagctggaccagaccaatcctgaggaagggctacagacagcgcctggagctgtcagacatctaccagatcccttctgtggactctgctgacaacctgtctgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcctctgctgctgggaagaatcatcgccagctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagtatcggacagctggtgagtctgctgtccaacaacctgaacaagttcgacgagggactggccctggcccacttcgtgtggatcgctcctctgcaggtggccctgctgatggggctgatctgggagctgctgcaggccagcgccttctgcggcctgggcttcctgatcgtgctggccctgttccaggccggcctgggcagaatgatgatgaagtacagagaccagagagctggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttctcagggttcttcgtggtgttcctgtctgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagagcttcaagcagaccggagagttcggcgagaagaggaagaacagcatcctgaacccaatcaacagcatcaggaagttcagcatcgtgcagaagaccccactgcagatgaacggcatcgaggaggacagcgacgagcccctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtag

SEQ ID NO: 30 - DNA, 4443 bp, synthetic construct
  misc_feature 1..4443: note = Synthetic construct
  source 1..4443: mol_type = other DNA
atgcagaggtcgcctctggagaaggctagcgtggtgtccaagctgttcttcagctggaccagaccaatcctgaggaagggctacagacagcgcctggagctgagcgacatctaccagatcccctctgtggacagcgctgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgcctcctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagtatcggacagctggtgagtctgctgagcaacaacctgaacaagttcgacgagggactggccctggcccacttcgtgtggatcgccccactgcaggtggccctgctgatggggctgatctgggagctgctgcaggcctctgccttctgcggcctgggcttcctgatcgtgctggccctgttccaggccggcctgggcagaatgatgatgaagtacagagaccagagagctggcaagatcagcgagagactggtgatcacctcagagatgatcgagaacatccagtctgtgaaggcatactgctgggaggaggccatggagaagatgatcgagaacctgagacagaccgagctgaagctgacccggaaggccgcctacgtgagatacttcaacagcagcgccttcttcttctcagggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagagcttcaagcagaccggagagttcggcgagaagaggaagaacagcatcctgaacccaatcaacagcatcaggaagttcagcatcgtgcagaagaccccactgcagatgaacggcatcgaggaggacagcgacgagcccctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtag

SEQ ID NO: 31 - DNA, 4443 bp, synthetic construct
  misc_feature 1..4443: note = Synthetic construct
  source 1..4443: mol_type = other DNA
atgcagcgcagccccctggagaaggccagcgtggtgagcaagctgttcttcagctggacccgccccatcctgcgcaagggctaccgccagcgcctggagctgagcgacatctaccagatccccagcgtggacagcgccgacaacctgagcgagaagctggagcgcgagtgggaccgcgagctggccagcaagaagaaccccaagctgatcaacgccctgcgccgctgcttcttctggagattcatgttctacggaatcttcctatacctaggggaagtcaccaaagcagtacagccactcctactgggaagaatcatagcaagctacgacccggacaacaaggaggaacgcagtatcgcgatatacctaggcataggcctatgcctactcttcatagtgaggacactgctcctacacccagccatattcggcctacatcacataggaatgcagatgagaatagcaatgttcagtctaatatacaagaagacactaaagctgtcaagccgagtactagacaaaataagtataggacaactagtaagtctcctaagcaacaacctgaacaaattcgacgaaggactagcactagcacatttcgtgtggatcgcaccactacaagtggcactcctcatggggctaatctgggagctactacaggcgagtgccttctgcggactaggtttcctgatagtcctagccctattccaggcagggctagggagaatgatgatgaagtacagagaccagagagcagggaagatcagtgaaagactagtgataacctcagaaatgatagaaaacatccaaagtgtaaaggcatactgctgggaagaagcaatggagaaaatgatagaaaacctaagacaaacagaactgaaactgacacggaaggcagcctacgtgagatacttcaacagctcagccttcttcttctcagggttcttcgtggtgttcctgagcgtgctgccctacgccctgatcaagggcatcatcctgcgcaagatcttcaccaccatctcattctgcatagtactgcgcatggcggtcacacggcaattcccctgggcagtacaaacatggtacgacagtctaggagcaataaacaaaatacaggacttcctacaaaagcaagaatacaagacactagaatacaacctaacgaccaccgaggtggtgatggagaacgtgaccgccttctgggaggagggcttcggcgagctgttcgagaaggccaagcagaacaacaacaaccgcaagaccagcaacggcgacgacagcctgttcttcagcaacttcagcctgctgggcacccccgtgctgaaggacatcaacttcaagatcgagcgcggccagctgctggccgtggccggcagcaccggcgccggcaagaccagcctgctgatggtgatcatgggcgagctggagcccagcgagggcaagatcaagcacagcggccgcatcagcttctgcagccagttcagctggatcatgcccggcaccatcaaggagaacatcatcttcggcgtgagctacgacgagtaccgctaccgcagcgtgatcaaggcctgccagctggaggaggacatcagcaagttcgccgagaaggacaacatcgtgctgggcgagggcggcatcaccctgagcggcggccagcgcgcccgcatcagcctggcccgcgccgtgtacaaggacgccgacctgtacctgctggacagccccttcggctacctggacgtgctgaccgagaaggagatcttcgagagctgcgtgtgcaagctgatggccaacaagacccgcatcctggtgaccagcaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagcgccgcaacagcatcctgaccgagaccctgcaccgcttcagcctggagggcgacgcccccgtgagctggaccgagaccaagaagcagagcttcaagcagaccggcgagttcggcgagaagcgcaagaacagcatcctgaaccccatcaacagcatccgcaagttcagcatcgtgcagaagaccccactgcagatgaacggcatcgaggaggacagcgacgagcccctggagcgccgcctgagcctggtgcccgacagcgagcagggcgaggccatcctgccccgcatcagcgtgatcagcaccggccccaccctgcaggcccgccgccgccagagcgtgctgaacctgatgacccacagcgtgaaccagggccagaacatccaccgcaagaccaccgccagcacccgcaaggtgagcctggccccacaggccaacctgaccgagctggacatctacagccgccgcctgagccaggagaccggcctggagatcagcgaggagatcaacgaggaggacctgaaggagtgcttcttcgacgacatggagagcatccccgccgtgaccacctggaacacctacctgcgctacatcaccgtgcacaagagcctaatattcgtgctaatatggtgcctagtaatattcctggcagaggtggcagcaagtctagtagtgctgtggctcctaggaaacacaccactacaagacaaagggaacagtacacatagtagaaacaacagctacgcagtgataatcaccagcaccagttcgtactacgtgttctacatatacgtgggagtagccgacacactactagcaatgggattcttcagaggtctaccactggtgcatacactaatcacagtgtcgaaaatactacaccacaaaatgctacatagtgtactacaagcaccaatgtcaaccctcaacacgctaaaagcaggtgggatactaaacagattcagcaaagacatagcaatactagacgacctactgccactaaccatattcgacttcatccagctactactaatagtgataggagcaatagcagtagtcgcagtactacaaccctacatcttcgtagcaacagtgccagtgatagtggcattcataatgctaagagcatacttcctccaaacctcacagcaactcaaacaactggaaagtgaaggcaggagtccaatattcacacatctagtaacaagcctaaaaggactatggacactacgagccttcggacggcagccatacttcgaaacactgttccacaaagcactgaacctacatacagccaactggttcctatacctgtcaacactgcgctggttccaaatgagaatagaaatgatattcgtcatcttcttcatagcagtaaccttcatcagcatcctgaccaccggcgagggcgagggccgcgtgggcataatcctgacactagccatgaacatcatgagtacactacagtgggcagtaaacagcagcatagacgtggacagcctaatgcgaagtgtgagccgagtcttcaagttcatagacatgccaacagaaggtaaaccaaccaagtcaaccaaaccatacaagaacggccaactctcgaaagtaatgataatagagaactcacacgtgaagaaagacgacatctggccctcagggggccagatgaccgtgaaggacctgaccgccaagtacaccgagggcggcaacgccatcctggagaacatcagcttcagcatcagccccggccagcgcgtgggcctgctgggccgcaccggcagcggcaagagcaccctgctgagcgccttcctgcgcctgctgaacaccgagggcgagatccagatcgacggcgtgagctgggacagcatcaccctgcagcagtggcgcaaggccttcggcgtgatcccccagaaggtgttcatcttcagcggcaccttccgcaagaacctggacccctacgagcagtggagcgaccaggagatctggaaggtggccgacgaggtgggcctgcgcagcgtgatcgagcagttccccggcaagctggacttcgtgctggtggacggcggctgcgtgctgagccacggccacaagcagctgatgtgcctggcccgcagcgtgctgagcaaggccaagatcctgctgctggacgagcccagcgcccacctggaccccgtgacctaccagatcatccgccgcaccctgaagcaggccttcgccgactgcaccgtgatcctgtgcgagcaccgcatcgaggccatgctggagtgccagcagttcctggtgatcgaggagaacaaggtgcgccagtacgacagcatccagaagctgctgaacgagcgcagcctgttccgccaggccatcagccccagcgaccgcgtgaagctgttcccccaccgcaacagcagcaagtgcaagagcaagccccagatcgccgccctgaaggaggagaccgaggaggaggtgcaggacacccgcctgtag

SEQ ID NO: 32 - DNA, 4443 bp, synthetic construct; identical to SEQ ID NO: 12
  misc_feature 1..4443: note = Synthetic construct
  source 1..4443: mol_type = other DNA

SEQ ID NO: 33 - DNA, 4443 bp, synthetic construct; identical to SEQ ID NO: 12
  misc_feature 1..4443: note = Synthetic construct
  source 1..4443: mol_type = other DNA

SEQ ID NO: 34 - DNA, 4443 bp, synthetic construct; identical to SEQ ID NO: 12
  misc_feature 1..4443: note = Synthetic construct
  source 1..4443: mol_type = other DNA

SEQ ID NO: 35 - DNA, 4443 bp, synthetic construct; identical to SEQ ID NO: 12
  misc_feature 1..4443: note = Synthetic construct
  source 1..4443: mol_type = other DNA

SEQ ID NO: 36 - DNA, 4443 bp, synthetic construct
  misc_feature 1..4443: note = Synthetic construct
  source 1..4443: mol_type = other DNA
atgcccaggagccccctggagaaggctagcgtggtgagcaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagagcttcaagcagaccggagagttcggcgagaagaggaagaacagcatcctgaacccaatcaacagcatcaggaagttcagcatcgtgcagaagaccccactgcagatgaacggcatcgaggaggacagcgacgagcccctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtag

SEQ ID NO: 37 - DNA, 4443 bp, synthetic construct
  misc_feature 1..4443: note = Synthetic construct
  source 1..4443: mol_type = other DNA
atgcccaggagccccctggagaaggctagcgtggtgagcaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagagcttcaagcagaccggagagttcggcgagaagaggaagaacagcatcctgaacccaatcaacagcatcaggaagttcagcatcgtgcagaagaccccactgcagatgaacggcatcgaggaggacagcgacgagcccctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagagagtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtag

SEQ ID NO: 38 - DNA, 4470 bp, synthetic construct
  misc_feature 1..4470: note = Synthetic construct
  source 1..4470: mol_type = other DNA
atgcagaggtcgcctctggagaaggccagcgtggtgtccaagctgttcttcagctggaccagaccaatcctgaggaagggctacagacagcgcctggagctgtcagacatctaccagatcccttctgtggactctgctgacaacctgtctgagaagctggagagagagtgggacagagagctggccagcaagaagaaccctaagctgatcaacgccctgcggaggtgcttcttctggagattcatgttctacggaatcttcctgtacctgggggaggtgaccaaggccgtgcagcctctgctgctgggaagaatcatcgcctcctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagtatcggacagctggtgagtctgctgtccaacaacctgaacaagttcgacgagggactggccctggcccacttcgtgtggatcgctcctctgcaggtggccctgctgatggggctgatctgggagctgctgcaggcctctgccttctgcggcctgggcttcctgatcgtgctggccctgttccaggccggcctgggcagaatgatgatgaagtacagagaccagagagctggcaagatcagcgagagactggtgatcacctcagagatgatcgagaacatccagtctgtgaaggcatactgctgggaggaggccatggagaagatgatcgagaacctgagacagaccgagctgaagctgacccggaaggccgcctacgtgagatacttcaacagcagcgccttcttcttctcagggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccctgtgctgaaggacatcaacttcaagatcgagagaggacagctgctggccgtggccggatccaccggagccggcaagacctcactgctgatggtgatcatgggagagctggagccttcagagggcaagatcaagcacagtggaagaatctcattctgctctcagttctcctggatcatgcctggcaccatcaaggagaacatcatcttcggtgtgtcctacgacgagtacagatacagaagcgtgatcaaggcctgccagctggaggaggacatctccaagttcgcagagaaggacaacatcgtgctgggagagggtggcatcaccctgagcggaggccagagggccagaatctctctggcaagagcagtgtacaaggacgctgacctgtacctgctggactctcctttcggatacctggacgtgctgaccgagaaggagatcttcgagagctgcgtgtgcaagctgatggccaacaagaccaggatcctggtgacctctaagatggagcacctgaagaaggctgacaagatcctgatcctgcacgagggcagcagctacttctacgggaccttcagcgagctgcagaacctgcagccagacttcagcagcaagctgatgggctgcgactctttcgaccagttcagcgccgagagaagaaacagcatcctgaccgagaccctgcacaggttcagcctggagggcgacgcccctgtgtcctggaccgagaccaagaagcagtctttcaagcagaccggagagttcggcgagaagaggaagaactctatcctgaacccaatcaactctatcaggaagttctccatcgtgcagaagacccccctgcagatgaacggcatcgaggaggactctgacgagcctctggagagaaggctgtccctggtgccagactctgagcagggcgaggccatcctgcctcgcatcagcgtgatcagcaccggccccaccctgcaggccaggaggaggcagtctgtgctgaacctgatgacccacagcgtgaaccagggccagaacatccacaggaagaccaccgcctccaccaggaaggtgagcctggcccctcaggccaacctgaccgagctggacatctacagcagaaggctgtctcaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgcctctctggtggtgctgtggctgctgggcaacacccctctgcaggacaagggcaacagcacccacagcagaaacaacagctacgccgtgatcatcaccagcaccagcagctactacgtgttctacatctacgtgggagtggccgacaccctgctggccatgggcttcttcagaggtctgccactggtgcacaccctgatcaccgtgagcaagatcctgcaccacaagatgctgcactctgtgctgcaggcccctatgagcaccctgaacaccctgaaggccggtgggatcctgaacagattctccaaggacatcgccatcctggacgacctgctgcctctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagtctgagggcaggagtccaatcttcacccacctggtgaccagcctgaagggactgtggaccctgagggccttcggccggcagccttacttcgagaccctgttccacaaggctctgaacctgcacaccgccaactggttcctgtacctgagcaccctgcgctggttccagatgagaatcgagatgatcttcgtgatcttcttcatcgccgtgaccttcatctccatcctgacctacccctacgacgtgcccgactacgccaccggcgagggagagggaagagtgggcatcatcctgaccctggccatgaacatcatgagcaccctgcagtgggctgtgaactccagcatcgacgtggacagcctgatgaggtctgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatctccttctcaatcagccctggccagagggtgggcctgctgggaagaaccggctcaggcaagagcaccctgctgagcgccttcctgagactgctgaacaccgagggcgagatccagatcgacggcgtgtcttgggactcaatcaccctgcagcagtggaggaaggccttcggcgtgatcccacagaaggtgttcatcttctctggaaccttcagaaagaacctggacccctacgagcagtggagcgaccaggagatctggaaggtggccgacgaggtgggcctgagatctgtgatcgagcagttccctggcaagctggacttcgtgctggtggacgggggctgcgtgctgagccacggccacaagcagctgatgtgcctggccagatctgtgctgagcaaggccaagatcctgctgctggacgagcccagtgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagcccctccgacagggtgaagctgttcccccaccggaacagcagcaagtgcaagtctaagccccagatcgccgccctgaaggaggagaccgaggaggaggtgcaggacaccaggctgtag

SEQ ID NO: 39 - DNA, 4470 bp, synthetic construct
  misc_feature 1..4470: note = Synthetic construct
  source 1..4470: mol_type = other DNA
atgcagaggtcgcctctggagaaggccagcgtggtgtccaagctgttcttcagctggaccagaccaatcctgaggaagggctacagacagcgcctggagctgtcagacatctaccagatcccttctgtggactctgctgacaacctgtctgagaagctggagagagagtgggacagagagctggccagcaagaagaaccctaagctgatcaacgccctgcggaggtgcttcttctggagattcatgttctacggaatcttcctgtacctgggggaggtgaccaaggccgtgcagcctctgctgctgggaagaatcatcgcctcctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagtatcggacagctggtgagtctgctgtccaacaacctgaacaagttcgacgagggactggccctggcccacttcgtgtggatcgctcctctgcaggtggccctgctgatggggctgatctgggagctgctgcaggcctctgccttctgcggcctgggcttcctgatcgtgctggccctgttccaggccggcctgggcagaatgatgatgaagtacagagaccagagagctggcaagatcagcgagagactggtgatcacctcagagatgatcgagaacatccagtctgtgaaggcatactgctgggaggaggccatggagaagatgatcgagaacctgagacagaccgagctgaagctgacccggaaggccgcctacgtgagatacttcaacagcagcgccttcttcttctcagggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccctgtgctgaaggacatcaacttcaagatcgagagaggacagctgctggccgtggccggatccaccggagccggcaagacctcactgctgatggtgatcatgggagagctggagccttcagagggcaagatcaagcacagtggaagaatctcattctgctctcagttctcctggatcatgcctggcaccatcaaggagaacatcatcttcggtgtgtcctacgacgagtacagatacagaagcgtgatcaaggcctgccagctggaggaggacatctccaagttcgcagagaaggacaacatcgtgctgggagagggtggcatcaccctgagcggaggccagagggccagaatctctctggcaagagcagtgtacaaggacgctgacctgtacctgctggactctcctttcggatacctggacgtgctgaccgagaaggagatcttcgagagctgcgtgtgcaagctgatggccaacaagaccaggatcctggtgacctctaagatggagcacctgaagaaggctgacaagatcctgatcctgcacgagggcagcagctacttctacgggaccttcagcgagctgcagaacctgcagccagacttcagcagcaagctgatgggctgcgactctttcgaccagttcagcgccgagagaagaaacagcatcctgaccgagaccctgcacaggttcagcctggagggcgacgcccctgtgtcctggaccgagaccaagaagcagtctttcaagcagaccggagagttcggcgagaagaggaagaactctatcctgaacccaatcaactctatcaggaagttctccatcgtgcagaagacccccctgcagatgaacggcatcgaggaggactctgacgagcctctggagagaaggctgtccctggtgccagactctgagcagggcgaggccatcctgcctcgcatcagcgtgatcagcaccggccccaccctgcaggccaggaggaggcagtctgtgctgaacctgatgacccacagcgtgaaccagggccagaacatccacaggaagaccaccgcctccaccaggaaggtgagcctggcccctcaggccaacctgaccgagctggacatctacagcagaaggctgtctcaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgcctctctggtggtgctgtggctgctgggcaacacccctctgcaggacaagggcaacagcacccacagcagaaacaacagctacgccgtgatcatcaccagcaccagcagctactacgtgttctacatctacgtgggagtggccgacaccctgctggccatgggcttcttcagaggtctgccactggtgcacaccctgatcaccgtgagcaagatcctgcaccacaagatgctgcactctgtgctgcaggcccctatgagcaccctgaacaccctgaaggccggtgggatcctgaacagattctccaaggacatcgccatcctggacgacctgctgcctctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagtctgagggcaggagtccaatcttcacccacctggtgaccagcctgaagggactgtggaccctgagggccttcggccggcagccttacttcgagaccctgttccacaaggctctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggctgtgaactccagcatcgacgtggacagcctgatgaggtctgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatctccttctcaatcagccctggccagagggtgggcctgctgggaagaaccggctcaggcaagagcaccctgctgagcgccttcctgagactgctgaacaccgagggcgagatccagatcgacggcgtgtcttgggactcaatcaccctgcagcagtggaggaaggccttcggcgtgatcccacagaaggtgttcatcttctctggaaccttcagaaagaacctggacccctacgagcagtggagcgaccaggagatctggaaggtggccgacgaggtgggcctgagatctgtgatcgagcagttccctggcaagctggacttcgtgctggtggacgggggctgcgtgctgagccacggccacaagcagctgatgtgcctggccagatctgtgctgagcaaggccaagatcctgctgctggacgagcccagtgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagcccctccgacagggtgaagctgttcccccaccggaacagcagcaagtgcaagtctaagccccagatcgccgccctgaaggaggagaccgaggaggaggtgcaggacaccaggctgtacccctacgacgtgcccgactacgcctag

SEQ ID NO: 40 - DNA, 4467 bp, synthetic construct
  misc_feature 1..4467: note = Synthetic construct
  source 1..4467: mol_type = other DNA
atgcagaggtcgcctctggagaaggccagcgtggtgtccaagctgttcttcagctggaccagaccaatcctgaggaagggctacagacagcgcctggagctgtcagacatctaccagatcccttctgtggactctgctgacaacctgtctgagaagctggagagagagtgggacagagagctggccagcaagaagaaccctaagctgatcaacgccctgcggaggtgcttcttctggagattcatgttctacggaatcttcctgtacctgggggaggtgaccaaggccgtgcagcctctgctgctgggaagaatcatcgcctcctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagtatcggacagctggtgagtctgctgtccaacaacctgaacaagttcgacgagggactggccctggcccacttcgtgtggatcgctcctctgcaggtggccctgctgatggggctgatctgggagctgctgcaggcctctgccttctgcggcctgggcttcctgatcgtgctggccctgttccaggccggcctgggcagaatgatgatgaagtacagagaccagagagctggcaagatcagcgagagactggtgatcacctcagagatgatcgagaacatccagtctgtgaaggcatactgctgggaggaggccatggagaagatgatcgagaacctgagacagaccgagctgaagctgacccggaaggccgcctacgtgagatacttcaacagcagcgccttcttcttctcagggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccctgtgctgaaggacatcaacttcaagatcgagagaggacagctgctggccgtggccggatccaccggagccggcaagacctcactgctgatggtgatcatgggagagctggagccttcagagggcaagatcaagcacagtggaagaatctcattctgctctcagttctcctggatcatgcctggcaccatcaaggagaacatcatcttcggtgtgtcctacgacgagtacagatacagaagcgtgatcaaggcctgccagctggaggaggacatctccaagttcgcagagaaggacaacatcgtgctgggagagggtggcatcaccctgagcggaggccagagggccagaatctctctggcaagagcagtgtacaaggacgctgacctgtacctgctggactctcctttcggatacctggacgtgctgaccgagaaggagatcttcgagagctgcgtgtgcaagctgatggccaacaagaccaggatcctggtgacctctaagatggagcacctgaagaaggctgacaagatcctgatcctgcacgagggcagcagctacttctacgggaccttcagcgagctgcagaacctgcagccagacttcagcagcaagctgatgggctgcgactctttcgaccagttcagcgccgagagaagaaacagcatcctgaccgagaccctgcacaggttcagcctggagggcgacgcccctgtgtcctggaccgagaccaagaagcagtctttcaagcagaccggagagttcggcgagaagaggaagaactctatcctgaacccaatcaactctatcaggaagttctccatcgtgcagaagacccccctgcagatgaacggcatcgaggaggactctgacgagcctctggagagaaggctgtccctggtgccagactctgagcagggcgaggccatcctgcctcgcatcagcgtgatcagcaccggccccaccctgcaggccaggaggaggcagtctgtgctgaacctgatgacccacagcgtgaaccagggccagaacatccacaggaagaccaccgcctccaccaggaaggtgagcctggcccctcaggccaacctgaccgagctggacatctacagcagaaggctgtctcaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgcctctctggtggtgctgtggctgctgggcaacacccctctgcaggacaagggcaacagcacccacagcagaaacaacagctacgccgtgatcatcaccagcaccagcagctactacgtgttctacatctacgtgggagtggccgacaccctgctggccatgggcttcttcagaggtctgccactggtgcacaccctgatcaccgtgagcaagatcctgcaccacaagatgctgcactctgtgctgcaggcccctatgagcaccctgaacaccctgaaggccggtgggatcctgaacagattctccaaggacatcgccatcctggacgacctgctgcctctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagtctgagggcaggagtccaatcttcacccacctggtgaccagcctgaagggactgtggaccctgagggccttcggccggcagccttacttcgagaccctgttccacaaggctctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggctgtgaactccagcatcgacgtggacagcctgatgaggtctgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatctccttctcaatcagccctggccagagggtgggcctgctgggaagaaccggctcaggcaagagcaccctgctgagcgccttcctgagactgctgaacaccgagggcgagatccagatcgacggcgtgtcttgggactcaatcaccctgcagcagtggaggaaggccttcggcgtgatcccacagaaggtgttcatcttctctggaaccttcagaaagaacctggacccctacgagcagtggagcgaccaggagatctggaaggtggccgacgaggtgggcctgagatctgtgatcgagcagttccctggcaagctggacttcgtgctggtggacgggggctgcgtgctgagccacggccacaagcagctgatgtgcctggccagatctgtgctgagcaaggccaagatcctgctgctggacgagcccagtgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagcccctccgacagggtgaagctgttcccccaccggaacagcagcaagtgcaagtctaagccccagatcgccgccctgaaggaggagaccgaggaggaggtgcaggacaccaggctggactacaaggacgatgacgataagtag

SEQ ID NO: 41 - DNA, 4587 bp, synthetic construct
  misc_feature 1..4587: note = Synthetic construct
  source 1..4587: mol_type = other DNA
atgcagaggtcgcctctggagaaggccagcgtggtgtccaagctgttcttcagctggaccagaccaatcctgaggaagggctacagacagcgcctggagctgtcagacatctaccagatcccttctgtggactctgctgacaacctgtctgagaagctggagagagagtgggacagagagctggccagcaagaagaaccctaagctgatcaacgccctgcggaggtgcttcttctggagattcatgttctacggaatcttcctgtacctgggggaggtgaccaaggccgtgcagcctctgctgctgggaagaatcatcgcctcctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagtatcggacagctggtgagtctgctgtccaacaacctgaacaagttcgacgagggactggccctggcccacttcgtgtggatcgctcctctgcaggtggccctgctgatggggctgatctgggagctgctgcaggcctctgccttctgcggcctgggcttcctgatcgtgctggccctgttccaggccggcctgggcagaatgatgatgaagtacagagaccagagagctggcaagatcagcgagagactggtgatcacctcagagatgatcgagaacatccagtctgtgaaggcatactgctgggaggaggccatggagaagatgatcgagaacctgagacagaccgagctgaagctgacccggaaggccgcctacgtgagatacttcaacagcagcgccttcttcttctcagggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccctgtgctgaaggacatcaacttcaagatcgagagaggacagctgctggccgtggccggatccaccggagccggcaagacctcactgctgatggtgatcatgggagagctggagccttcagagggcaagatcaagcacagtggaagaatctcattctgctctcagttctcctggatcatgcctggcaccatcaaggagaacatcatcttcggtgtgtcctacgacgagtacagatacagaagcgtgatcaaggcctgccagctggaggaggacatctccaagttcgcagagaaggacaacatcgtgctgggagagggtggcatcaccctgagcggaggccagagggccagaatctctctggcaagagcagtgtacaaggacgctgacctgtacctgctggactctcctttcggatacctggacgtgctgaccgagaaggagatcttcgagagctgcgtgtgcaagctgatggccaacaagaccaggatcctggtgacctctaagatggagcacctgaagaaggctgacaagatcctgatcctgcacgagggcagcagctacttctacgggaccttcagcgagctgcagaacctgcagccagacttcagcagcaagctgatgggctgcgactctttcgaccagttcagcgccgagagaagaaacagcatcctgaccgagaccctgcacaggttcagcctggagggcgacgcccctgtgtcctggaccgagaccaagaagcagtctttcaagcagaccggagagttcggcgagaagaggaagaactctatcctgaacccaatcaactctatcaggaagttctccatcgtgcagaagacccccctgcagatgaacggcatcgaggaggactctgacgagcctctggagagaaggctgtccctggtgccagactctgagcagggcgaggccatcctgcctcgcatcagcgtgatcagcaccggccccaccctgcaggccaggaggaggcagtctgtgctgaacctgatgacccacagcgtgaaccagggccagaacatccacaggaagaccaccgcctccaccaggaaggtgagcctggcccctcaggccaacctgaccgagctggacatctacagcagaaggctgtctcaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgcctctctggtggtgctgtggctgctgggcaacacccctctgcaggacaagggcaacagcacccacagcagaaacaacagctacgccgtgatcatcaccagcaccagcagctactacgtgttctacatctacgtgggagtggccgacaccctgctggccatgggcttcttcagaggtctgccactggtgcacaccctgatcaccgtgagcaagatcctgcaccacaagatgctgcactctgtgctgcaggcccctatgagcaccctgaacaccctgaaggccggtgggatcctgaacagattctccaaggacatcgccatcctggacgacctgctgcctctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagtctgagggcaggagtccaatcttcacccacctggtgaccagcctgaagggactgtggaccctgagggccttcggccggcagccttacttcgagaccctgttccacaaggctctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggctgtgaactccagcatcgacgtggacagcctgatgaggtctgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatctccttctcaatcagccctggccagagggtgggcctgctgggaagaaccggctcaggcaagagcaccctgctgagcgccttcctgagactgctgaacaccgagggcgagatccagatcgacggcgtgtcttgggactcaatcaccctgcagcagtggaggaaggccttcggcgtgatcccacagaaggtgttcatcttctctggaaccttcagaaagaacctggacccctacgagcagtggagcgaccaggagatctggaaggtggccgacgaggtgggcctgagatctgtgatcgagcagttccctggcaagctggacttcgtgctggtggacgggggctgcgtgctgagccacggccacaagcagctgatgtgcctggccagatctgtgctgagcaaggccaagatcctgctgctggacgagcccagtgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagcccctccgacagggtgaagctgttcccccaccggaacagcagcaagtgcaagtctaagccccagatcgccgccctgaaggaggagaccgaggaggaggtgcaggacaccaggctgggcggcggcagcggcgagcagaaactgatcagcgaagaggatctgaacggcggcggcagcggcgagcagaaactgatcagcgaagaggatctgaacggcggcggcagcggcgagcagaaactgatcagcgaagaggatctgaactag

SEQ ID NO: 42 - DNA, 4476 bp, synthetic construct
  misc_feature 1..4476: note = Synthetic construct
  source 1..4476: mol_type = other DNA
atgcagaggtcgcctctggagaaggccagcgtggtgtccaagctgttcttcagctggaccagaccaatcctgaggaagggctacagacagcgcctggagctgtcagacatctaccagatcccttctgtggactctgctgacaacctgtctgagaagctggagagagagtgggacagagagctggccagcaagaagaaccctaagctgatcaacgccctgcggaggtgcttcttctggagattcatgttctacggaatcttcctgtacctgggggaggtgaccaaggccgtgcagcctctgctgctgggaagaatcatcgcctcctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagtatcggacagctggtgagtctgctgtccaacaacctgaacaagttcgacgagggactggccctggcccacttcgtgtggatcgctcctctgcaggtggccctgctgatggggctgatctgggagctgctgcaggcctctgccttctgcggcctgggcttcctgatcgtgctggccctgttccaggccggcctgggcagaatgatgatgaagtacagagaccagagagctggcaagatcagcgagagactggtgatcacctcagagatgatcgagaacatccagtctgtgaaggcatactgctgggaggaggccatggagaagatgatcgagaacctgagacagaccgagctgaagctgacccggaaggccgcctacgtgagatacttcaacagcagcgccttcttcttctcagggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccctgtgctgaaggacatcaacttcaagatcgagagaggacagctgctggccgtggccggatccaccggagccggcaagacctcactgctgatggtgatcatgggagagctggagccttcagagggcaagatcaagcacagtggaagaatctcattctgctctcagttctcctggatcatgcctggcaccatcaaggagaacatcatcttcggtgtgtcctacgacgagtacagatacagaagcgtgatcaaggcctgccagctggaggaggacatctccaagttcgcagagaaggacaacatcgtgctgggagagggtggcatcaccctgagcggaggccagagggccagaatctctctggcaagagcagtgtacaaggacgctgacctgtacctgctggactctcctttcggatacctggacgtgctgaccgagaaggagatcttcgagagctgcgtgtgcaagctgatggccaacaagaccaggatcctggtgacctctaagatggagcacctgaagaaggctgacaagatcctgatcctgcacgagggcagcagctacttctacgggaccttcagcgagctgcagaacctgcagccagacttcagcagcaagctgatgggctgcgactctttcgaccagttcagcgccgagagaagaaacagcatcctgaccgagaccctgcacaggttcagcctggagggcgacgcccctgtgtcctggaccgagaccaagaagcagtctttcaagcagaccggagagttcggcgagaagaggaagaactctatcctgaacccaatcaactctatcaggaagttctccatcgtgcagaagacccccctgcagatgaacggcatcgaggaggactctgacgagcctctggagagaaggctgtccctggtgccagactctgagcagggcgaggccatcctgcctcgcatcagcgtgatcagcaccggccccaccctgcaggccaggaggaggcagtctgtgctgaacctgatgacccacagcgtgaaccagggccagaacatccacaggaagaccaccgcctccaccaggaaggtgagcctggcccctcaggccaacctgaccgagctggacatctacagcagaaggctgtctcaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgcctctctggtggtgctgtggctgctgggcaacacccctctgcaggacaagggcaacagcacccacagcagaaacaacagctacgccgtgatcatcaccagcaccagcagctactacgtgttctacatctacgtgggagtggccgacaccctgctggccatgggcttcttcagaggtctgccactggtgcacaccctgatcaccgtgagcaagatcctgcaccacaagatgctgcactctgtgctgcaggcccctatgagcaccctgaacaccctgaaggccggtgggatcctgaacagattctccaaggacatcgccatcctggacgacctgctgcctctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagtctgagggcaggagtccaatcttcacccacctggtgaccagcctgaagggactgtggaccctgagggccttcggccggcagccttacttcgagaccctgttccacaaggctctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggctgtgaactccagcatcgacgtggacagcctgatgaggtctgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatctccttctcaatcagccctggccagagggtgggcctgctgggaagaaccggctcaggcaagagcaccctgctgagcgccttcctgagactgctgaacaccgagggcgagatccagatcgacggcgtgtcttgggactcaatcaccctgcagcagtggaggaaggccttcggcgtgatcccacagaaggtgttcatcttctctggaaccttcagaaagaacctggacccctacgagcagtggagcgaccaggagatctggaaggtggccgacgaggtgggcctgagatctgtgatcgagcagttccctggcaagctggacttcgtgctggtggacgggggctgcgtgctgagccacggccacaagcagctgatgtgcctggccagatctgtgctgagcaaggccaagatcctgctgctggacgagcccagtgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagcccctccgacagggtgaagctgttcccccaccggaacagcagcaagtgcaagtctaagccccagatcgccgccctgaaggaggagaccgaggaggaggtgcaggacaccaggctggtgagcggctggcggctgttcaagaagattagctag

SEQ ID NO: 43 - DNA, 5184 bp, synthetic construct
  misc_feature 1..5184: note = Synthetic construct
  source 1..5184: mol_type = other DNA
atgcagaggtcgcctctggagaaggccagcgtggtgtccaagctgttcttcagctggaccagaccaatcctgaggaagggctacagacagcgcctggagctgtcagacatctaccagatcccttctgtggactctgctgacaacctgtctgagaagctggagagagagtgggacagagagctggccagcaagaagaaccctaagctgatcaacgccctgcggaggtgcttcttctggagattcatgttctacggaatcttcctgtacctgggggaggtgaccaaggccgtgcagcctctgctgctgggaagaatcatcgcctcctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagtatcggacagctggtgagtctgctgtccaacaacctgaacaagttcgacgagggactggccctggcccacttcgtgtggatcgctcctctgcaggtggccctgctgatggggctgatctgggagctgctgcaggcctctgccttctgcggcctgggcttcctgatcgtgctggccctgttccaggccggcctgggcagaatgatgatgaagtacagagaccagagagctggcaagatcagcgagagactggtgatcacctcagagatgatcgagaacatccagtctgtgaaggcatactgctgggaggaggccatggagaagatgatcgagaacctgagacagaccgagctgaagctgacccggaaggccgcctacgtgagatacttcaacagcagcgccttcttcttctcagggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccctgtgctgaaggacatcaacttcaagatcgagagaggacagctgctggccgtggccggatccaccggagccggcaagacctcactgctgatggtgatcatgggagagctggagccttcagagggcaagatcaagcacagtggaagaatctcattctgctctcagttctcctggatcatgcctggcaccatcaaggagaacatcatcttcggtgtgtcctacgacgagtacagatacagaagcgtgatcaaggcctgccagctggaggaggacatctccaagttcgcagagaaggacaacatcgtgctgggagagggtggcatcaccctgagcggaggccagagggccagaatctctctggcaagagcagtgtacaaggacgctgacctgtacctgctggactctcctttcggatacctggacgtgctgaccgagaaggagatcttcgagagctgcgtgtgcaagctgatggccaacaagaccaggatcctggtgacctctaagatggagcacctgaagaaggctgacaagatcctgatcctgcacgagggcagcagctacttctacgggaccttcagcgagctgcagaacctgcagccagacttcagcagcaagctgatgggctgcgactctttcgaccagttcagcgccgagagaagaaacagcatcctgaccgagaccctgcacaggttcagcctggagggcgacgcccctgtgtcctggaccgagaccaagaagcagtctttcaagcagaccggagagttcggcgagaagaggaagaactctatcctgaacccaatcaactctatcaggaagttctccatcgtgcagaagacccccctgcagatgaacggcatcgaggaggactctgacgagcctctggagagaaggctgtccctggtgccagactctgagcagggcgaggccatcctgcctcgcatcagcgtgatcagcaccggccccaccctgcaggccaggaggaggcagtctgtgctgaacctgatgacccacagcgtgaaccagggccagaacatccacaggaagaccaccgcctccaccaggaaggtgagcctggcccctcaggccaacctgaccgagctggacatctacagcagaaggctgtctcaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgcctctctggtggtgctgtggctgctgggcaacacccctctgcaggacaagggcaacagcacccacagcagaaacaacagctacgccgtgatcatcaccagcaccagcagctactacgtgttctacatctacgtgggagtggccgacaccctgctggccatgggcttcttcagaggtctgccactggtgcacaccctgatcaccgtgagcaagatcctgcaccacaagatgctgcactctgtgctgcaggcccctatgagcaccctgaacaccctgaaggccggtgggatcctgaacagattctccaaggacatcgccatcctggacgacctgctgcctctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagtctgagggcaggagtccaatcttcacccacctggtgaccagcctgaagggactgtggaccctgagggccttcggccggcagccttacttcgagaccctgttccacaaggctctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggctgtgaactccagcatcgacgtggacagcctgatgaggtctgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatctccttctcaatcagccctggccagagggtgggcctgctgggaagaaccggctcaggcaagagcaccctgctgagcgccttcctgagactgctgaacaccgagggcgagatccagatcgacggcgtgtcttgggactcaatcaccctgcagcagtggaggaaggccttcggcgtgatcccacagaaggtgttcatcttctctggaaccttcagaaagaacctggacccctacgagcagtggagcgaccaggagatctggaaggtggccgacgaggtgggcctgagatctgtgatcgagcagttccctggcaagctggacttcgtgctggtggacgggggctgcgtgctgagccacggccacaagcagctgatgtgcctggccagatctgtgctgagcaaggccaagatcctgctgctggacgagcccagtgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagcccctccgacagggtgaagctgttcccccaccggaacagcagcaagtgcaagtctaagccccagatcgccgccctgaaggaggagaccgaggaggaggtgcaggacaccaggctgggcggcggcggcagcggcggcagcagcgtgagcaagggcgaggagctgttcaccggcgtggtgcccatcctggtggagctggacggcgacgtgaacggccacaagttcagcgtgagcggcgagggcgagggcgacgccacctacggcaagctgaccctgaagttcatctgcaccaccggcaagctgcccgtgccctggcccaccctggtgaccaccctgacctacggcgtgcagtgcttcagcaggtaccccgaccacatgaagcagcacgacttcttcaagagcgccatgcccgagggctacgtgcaggagaggaccatcttcttcaaggacgacggcaactacaagaccagggccgaggtgaagttcgagggcgacaccctggtgaacaggatcgagctgaagggcatcgacttcaaggaggacggcaacatcctgggccacaagctggagtacaactacaacagccacaacgtgtacatcatggccgacaagcagaagaacggcatcaaggtgaacttcaagatcaggcacaacatcgaggacggcagcgtgcagctggccgaccactaccagcagaacacccccatcggcgacggccccgtgctgctgcccgacaaccactacctgagcacccagagcgccctgagcaaggaccccaacgagaagagggaccacatggtgctgctggagttcgtgaccgccgccggcatcaccctgggcatggacgagctgtacaagtag

SEQ ID NO: 44 - DNA, 4443 bp, synthetic construct; identical to SEQ ID NO: 1
  misc_feature 1..4443: note = Synthetic construct
  source 1..4443: mol_type = other DNA

SEQ ID NO: 45 - DNA, 4443 bp, synthetic construct; identical to SEQ ID NO: 7
  misc_feature 1..4443: note = Synthetic construct
  source 1..4443: mol_type = other DNA

SEQ ID NO: 46 - DNA, 4443 bp, synthetic construct; identical to SEQ ID NO: 26
  misc_feature 1..4443: note = Synthetic construct
  source 1..4443: mol_type = other DNA

SEQ ID NO: 47 - RNA, 4746 nt, Homo sapiens
  source 1..4746: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggtcgcctctggaaaaggccagcgttgtctccaaactttttttcagctggaccagaccaattttgaggaaaggatacagacagcgcctggaattgtcagacatataccaaatcccttctgttgattctgctgacaatctatctgaaaaattggaaagagaatgggatagagagctggcttcaaagaaaaatcctaaactcattaatgcccttcggcgatgttttttctggagatttatgttctatggaatctttttatatttaggggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaagactttaaagctgtcaagccgtgttctagataaaataagtattggacaacttgttagtctcctttccaacaacctgaacaaatttgatgaaggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacagagatcagagagctgggaagatcagtgaaagactcgtaattacctcagaaatgattgagaacatccaatctgttaaggcatactgctgggaagaagcaatggaaaaaatgattgaaaacttaagacaaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggatttcttacaaaagcaagaatataagacattggaatataacttaacgactacagaagtagtgatggagaatgtaacagccttctgggaggagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaagacttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggacatctccaagtttgcagagaaagacaatatagttcttggagaaggtggaatcacactgagtggaggtcaacgagcaagaatttctttagcaagagcagtatacaaagatgctgatttgtatttattagactctccttttggatacctagatgttttaacagaaaaagaaatatttgaaagctgtgtctgtaaactgatggctaacaaaactaggattttggtcacttctaaaatggaacatttaaagaaagctgacaaaatattaattttgcatgaaggtagcagctatttttatgggacattttcagaactccaaaatctacagccagactttagctcaaaactcatgggatgtgattctttcgaccaatttagtgcagaaagaagaaattcaatcctaactgagacattacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggagtgcttttttgatgatatggagagcataccagcagtgactacatggaacacataccttcgatatattactgtccacaagagcttaatttttgtgctaatttggtgcttagtaatttttctggcagaggtggctgcttctttggttgtgctgtggctccttggaaacactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtgggattcttaatagattctccaaagatatagcaattttggatgaccttctgcctcttaccatatttgacttcatccagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaatatcatgagtacattgcagtgggctgtaaactccagcatagatgtggatagcttgatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacagaaagtatttattttttctggaacatttagaaaaaacttggatccctatgaacagtggagtgatcaagaaatatggaaagttgcagatgaggttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatccagtaacataccaaataattagaagaactctaaaacaagcatttgctgattgcacagtaattctctgtgaacacaggatagaagcaatgctggaatgccaacaatttttggtcatagaagagaacaaagtgcggcagtacgattccatccagaaactgctgaacgagaggagcctcttccggcaagccatcagcccctccgacagggtgaagctctttccccaccggaactcaagcaagtgcaagtctaagccccagattgctgctctgaaagaggagacagaagaagaggtgcaagatacaaggctttagctcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 48 - RNA, 4752 nt, synthetic construct
  misc_feature 1..4752: note = Synthetic construct
  source 1..4752: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggtcgcctctggagaaggccagcgttgtctccaagctgttcttcagctggaccagaccaattttgaggaaaggatacagacagcgcctggaattgtcagacatataccaaatcccttctgttgattctgctgacaatctatctgagaagttggaaagagaatgggatagagagctggcttccaagaagaaccctaagctcattaatgcccttcggcgatgctttttctggaggttcatgttctatggaatcttcctgtacttaggggaggtcaccaaggcagtacagcctctcttgctgggcagaatcatagcttcctatgaccctgataacaaggaggaacgcagcatcgcgatctacctgggcatcggcttgtgcctgctctttatcgtgaggacactgctcctacaccctgccatctttggccttcatcacattggaatgcagatgagaatcgctatgttcagtttgatttacaagaagactttaaagctgtccagcagggtgctagataagatcagcattggacagcttgttagcctgctttccaacaacctgaacaagttcgatgaaggactggcattggcacatttcgtgtggatcgctcctctgcaagtggcactcctgatggggttgatctgggagttgctgcaggcgagcgccttctgtggacttggcttcctgatagtccttgccctgttccaggctgggctagggagaatgatgatgaagtacagagatcagagggctgggaagatcagcgagagactcgtgatcacctctgagatgatcgagaacatccagtctgtgaaggcatactgctgggaagaggcaatggagaagatgattgagaacttaagacagacagagctgaagctgactcggaaggcagcctatgtgagatacttcaacagctcagccttcttcttcagcgggttctttgtggtcttcctgtctgtgcttccctatgcactaatcaagggaatcattctgcggaagatcttcacaaccatctccttctgcattgtgctgcgcatggcggtcactcggcagtttccctgggctgtacagacatggtatgactctctgggagccatcaacaagatacaggatttcctgcagaagcaagagtataagacattggagtacaacttaacgactacagaagtagtgatggagaacgtaaccgccttctgggaggagggatttggggagttgttcgagaaagcaaagcagaacaacaataatcggaagacctccaatggtgatgacagcctcttcttcagtaacttcagccttcttggtactcctgtcctgaaggacatcaacttcaagatagagaggggacagttgttggcggttgctggatccactggagcaggcaagacttcacttctaatggtgatcatgggagaactggagcctagcgagggcaagatcaagcacagtggaaggatctcattctgttctcagttttcctggattatgcctggcaccattaaggagaacatcatctttggtgtttcctatgatgagtaccgctacagaagcgtcatcaaggcatgccaactagaagaggacatctccaagtttgcagagaaggacaatatagttcttggagaaggtggaatcacactgagtggaggtcaacgagcaagaatctctttagcaagagcagtatacaaggacgctgatttgtacttgttagactctccctttggatacctagatgtgctgaccgagaaggagatattcgaaagctgtgtctgtaagctgatggctaacaagactaggatcttggtcacttctaagatggaacacctgaagaaagctgacaagatcttgatcctgcatgaaggttctagctacttctacgggacattttcagaactccagaatctacagccagactttagctcaaagctcatgggatgtgattctttcgaccagtttagtgcagagagacggaactcaatcctaactgagacattacaccgtttctcattagaaggagatgctcctgtctcctggacagagacgaagaaacagtcttttaaacagactggagagtttggggagaaacgcaagaacagcattctcaatccaatcaactctatacgaaagttctccattgtgcagaagactcccttacagatgaatggcatcgaagaggattctgatgagcctttagagagaaggctgtccttagtaccagattctgagcagggagaggcgatactgcctcgcatcagcgtgatcagcactggccccacgcttcaggcacgaaggcgccagtctgtcctgaacctgatgacacactcagttaaccaaggtcagaacattcaccgaaagacaaccgcatccacaaggaaggtgtcactggcccctcaggcaaacttgactgaactggacatctactccagaaggttatctcaggagactggcttggagatcagtgaagagattaacgaagaggacttaaaggagtgcttctttgatgatatggagagcataccagcagtgactacatggaacacataccttaggtacatcactgtccacaagagcctgatcttcgtgctaatttggtgcttggtgatcttcctggcagaggtggctgcttctttggttgtgctgtggctccttggaaacactcctcttcaagacaaagggaatagtactcattccagcaacaattcctatgcagtgattatcaccagcaccagttcgtattatgtgttctacatttacgtgggagtagccgacactttgcttgctatgggattcttcagaggtctaccactggtgcatactctaatcacagtgtcgaagatcctgcatcacaagatgttacattctgttcttcaagcacctatgtcaaccctcaacacgttgaaggcaggtgggattctgaacaggttctccaaggatatagccatcctggatgaccttctgcctcttaccatctttgacttcatccagttgttactgatcgtgattggagctatagcagttgtcgcagtgttacaaccctacatcttcgttgcaacagtgccagtgatagtggctttcattatgttgagagcatatttcctccaaacctcacagcaactcaagcagctggaatctgaaggcaggagtccaattttcactcatcttgttacaagcctgaagggactctggacattgcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaacatcatgagtacattgcagtgggctgtgaactccagcatagatgtggatagcttgatgcgatctgtgagccgagtcttcaagttcattgacatgcccaccgagggtaagcctaccaagtccaccaagccctacaagaatggccaactctcgaaggttatgatcattgagaattcacacgtgaagaaagatgacatctggccctcagggggccaaatgactgtcaaagatctcacagccaagtacacagaaggtggaaatgccatcctggagaacatttccttcagcatcagtcctggccagagggtgggcctcttgggaagaactggatcagggaagagtactttgttatcagccttcttgagactactgaacactgaaggcgagatccagatcgatggtgtgtcttgggacagcatcactttgcaacagtggaggaaggccttcggcgtgataccacagaaggtgttcatcttctccggaaccttcaggaagaacttggatccctatgaacagtggagtgatcaggagatctggaaggttgcagatgaggttgggctcagatctgtgatagaacagtttcctgggaagcttgactttgtccttgtggatgggggctgtgtcctaagccacggccacaagcagttgatgtgcttggctagatctgttctcagtaaggcgaagatcttgctgcttgatgaacccagtgctcatttggatccagtaacataccagatcattcggagaactctgaagcaggcatttgctgattgcacagtaattctctgtgaacacaggatagaagcaatgctggaatgccaacagttcttggtcatcgaagagaacaaggtgcggcagtacgattccatccagaagctgctgaacgagaggagcctcttccggcaagccatcagcccctccgacagggtgaagctctttccccaccggaactcaagcaagtgcaagtctaagccccagatcgccgctctgaaggaagagactgaggaagaggtgcaggataccaggctgtgataatagctcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 49 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagcgcagccccctcgagaaggccagcgtggtgagcaagctgttcttcagctggacccgccccatcctgcgcaagggctaccgccagcgcctggagctgagcgacatctaccagatccccagcgtggacagcgccgacaacctgagcgagaagctggagcgcgagtgggaccgcgagctggccagcaagaagaaccccaagctgatcaacgccctgcgccgctgcttcttctggcgcttcatgttctacggcatcttcctgtacctgggcgaggtgaccaaggccgtgcagcccctgctgctgggccgcatcatcgccagctacgaccccgacaacaaggaggagcgcagcatcgccatctacctgggcatcggcctgtgcctgctgttcatcgtgcgcaccctgctgctgcaccccgccatcttcggcctgcaccacatcggcatgcagatgcgcatcgccatgttcagcctgatctacaagaagaccctgaagctgagcagccgcgtgctggacaagatcagcatcggccagctggtgagcctgctgagcaacaacctgaacaagttcgacgagggcctggccctggcccacttcgtgtggatcgcccccctgcaggtggccctgctgatgggcctgatctgggagctgctgcaggccagcgccttctgcggcctgggcttcctgatcgtgctggccctgttccaggccggcctgggccgcatgatgatgaagtaccgcgaccagcgcgccggcaagatcagcgagcgcctggtgatcaccagcgagatgatcgagaacatccagagcgtgaaggcctactgctgggaggaggccatggagaagatgatcgagaacctgcgccagaccgagctgaagctgacccgcaaggccgcctacgtgcgctacttcaacagcagcgccttcttcttcagcggcttcttcgtggtgttcctgagcgtgctgccctacgccctgatcaagggcatcatcctgcgcaagatcttcaccaccatcagcttctgcatcgtgctgcgcatggccgtgacccgccagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagggcttcggcgagctgttcgagaaggccaagcagaacaacaacaaccgcaagaccagcaacggcgacgacagcctgttcttcagcaacttcagcctgctgggcacccccgtgctgaaggacatcaacttcaagatcgagcgcggccagctgctggccgtggccggcagcaccggcgccggcaagaccagcctgctgatggtgatcatgggcgagctggagcccagcgagggcaagatcaagcacagcggccgcatcagcttctgcagccagttcagctggatcatgcccggcaccatcaaggagaacatcatcttcggcgtgagctacgacgagtaccgctaccgcagcgtgatcaaggcctgccagctggaggaggacatcagcaagttcgccgagaaggacaacatcgtgctgggcgagggcggcatcaccctgagcggcggccagcgcgcccgcatcagcctggcccgcgccgtgtacaaggacgccgacctgtacctgctggacagccccttcggctacctggacgtgctgaccgagaaggagatcttcgagagctgcgtgtgcaagctgatggccaacaagacccgcatcctggtgaccagcaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagcgccgcaacagcatcctgaccgagaccctgcaccgcttcagcctggagggcgacgcccccgtgagctggaccgagaccaagaagcagagcttcaagcagaccggcgagttcggcgagaagcgcaagaacagcatcctgaaccccatcaacagcatccgcaagttcagcatcgtgcagaagacccccctgcagatgaacggcatcgaggaggacagcgacgagcccctggagcgccgcctgagcctggtgcccgacagcgagcagggcgaggccatcctgccccgcatcagcgtgatcagcaccggccccaccctgcaggcccgccgccgccagagcgtgctgaacctgatgacccacagcgtgaaccagggccagaacatccaccgcaagaccaccgccagcacccgcaaagtgagcctggccccccaggccaacctgaccgagctggacatctacagccgccgcctgagccaggagaccggcctggagatcagcgaggagatcaacgaggaggacctgaaggagtgcttcttcgacgacatggagagcatccccgccgtgaccacctggaacacctacctgcgctacatcaccgtgcacaagagcctgatcttcgtgctgatctggtgcctggtgatcttcctggccgaggtggccgccagcctggtggtgctgtggctgctgggcaacacccccctgcaggacaagggcaacagcacccacagccgcaacaacagctacgccgtgatcatcaccagcaccagcagctactacgtgttctacatctacgtgggcgtggccgacaccctgctggccatgggcttcttccgcggcctgcccctggtgcacaccctgatcaccgtgagcaagatcctgcaccacaagatgctgcacagcgtgctgcaggcccccatgagcaccctgaacaccctgaaggccggcggcatcctgaaccgcttcagcaaggacatcgccatcctggacgacctgctgcccctgaccatcttcgacttcatccagctgctgctgatcgtgatcggcgccatcgccgtggtggccgtgctgcagccctacatcttcgtggccaccgtgcccgtgatcgtggccttcatcatgctgcgcgcctacttcctgcagaccagccagcagctgaagcagctggagagcgagggccgcagccccatcttcacccacctggtgaccagcctgaagggcctgtggaccctgcgcgccttcggccgccagccctacttcgagaccctgttccacaaggccctgaacctgcacaccgccaactggttcctgtacctgagcaccctgcgctggttccagatgcgcatcgagatgatcttcgtgatcttcttcatcgccgtgaccttcatcagcatcctgaccaccggcgagggcgagggccgcgtgggcatcatcctgaccctggccatgaacatcatgagcaccctgcagtgggccgtgaacagcagcatcgacgtggacagcctgatgcgcagcgtgagccgcgtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagcgcgtgggcctgctgggccgcaccggcagcggcaagagcaccctgctgagcgccttcctgcgcctgctgaacaccgagggcgagatccagatcgacggcgtgagctgggacagcatcaccctgcagcagtggcgcaaggccttcggcgtgatcccccagaaggtgttcatcttcagcggcaccttccgcaagaacctggacccctacgagcagtggagcgaccaggagatctggaaggtggccgacgaggtgggcctgcgcagcgtgatcgagcagttccccggcaagctggacttcgtgctggtggacggcggctgcgtgctgagccacggccacaagcagctgatgtgcctggcccgcagcgtgctgagcaaggccaagatcctgctgctggacgagcccagcgcccacctggaccccgtgacctaccagatcatccgccgcaccctgaagcaggccttcgccgactgcaccgtgatcctgtgcgagcaccgcatcgaggccatgctggagtgccagcagttcctggtgatcgaggagaacaaggtgcgccagtacgacagcatccagaagctgctgaacgagcgcagcctgttccgccaggccatcagccccagcgaccgcgtgaagcttttcccccaccgcaacagcagcaagtgcaagagcaagccccagatcgccgccctgaaggaggagaccgaggaggaggtgcaggacacccgcctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 50 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggtcgcctctggagaaggccagcgttgtctccaagctgttcttcagctggaccagaccaattttgaggaaaggatacagacagcgcctggaattgtcagacatataccaaatcccttctgttgattctgctgacaatctatctgagaagttggaaagagaatgggatagagagctggcttccaagaagaaccctaagctcattaatgcccttcggcgatgctttttctggaggttcatgttctatggaatcttcctgtacttaggggaggtcaccaaggcagtacagcctctcttgctgggcagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaagactttaaagctgtcaagccgtgttctagataaaataagtattggacaacttgttagtctcctttccaacaacctgaacaaatttgatgaaggacttgcattggcacatttcgtgtggatcgctcctctgcaagtggcactcctgatggggttgatctgggagttgctgcaggcgagcgccttctgtggacttggcttcctgatagtccttgccctgttccaggctgggctagggagaatgatgatgaagtacagagatcagagggctgggaagatcagcgagagactcgtgatcacctctgagatgatcgagaacatccagtctgtgaaggcatactgctgggaagaggcaatggagaagatgattgagaacttaagacagacagagctgaagctgactcggaaggcagcctatgtgagatacttcaacagctcagccttcttcttcagcgggttctttgtggtcttcctgtctgtgcttccctatgcactaatcaagggaatcattctgcggaagatcttcacaaccatctccttctgcattgtgctgcgcatggcggtcactcggcagtttccctgggctgtacagacatggtatgactctctgggagccatcaacaagatacaggatttcctgcagaagcaagagtataagacattggagtacaacttaacgactacagaagtagtgatggagaacgtaaccgccttctgggaggagggatttggggagttgttcgagaaagcaaagcagaacaacaataatcggaagacctccaatggtgatgacagcctcttcttcagtaacttcagccttcttggtactcctgtcctgaaggacatcaacttcaagatagagaggggacagttgttggcggttgctggatccactggagcaggcaagacttcacttctaatggtgatcatgggagaactggagcctagcgagggcaagatcaagcacagtggaaggatctcattctgttctcagttttcctggattatgcctggcaccattaaggagaacatcatctttggtgtttcctatgatgagtaccgctacagaagcgtcatcaaggcatgccaactagaagaggacatctccaagtttgcagagaaggacaatatagttcttggagaaggtggaatcacactgagtggaggtcaacgagcaagaatctctttagcaagagcagtatacaaggacgctgatttgtacttgttagactctccctttggatacctagatgtgctgaccgagaaggagatattcgaaagctgtgtctgtaagctgatggctaacaagactaggatcttggtcacttctaagatggaacacctgaagaaagctgacaagatcttgatcctgcatgaaggttctagctacttctacgggacattttcagaactccagaatctacagccagactttagctcaaagctcatgggatgtgattctttcgaccagtttagtgcagagagacggaactcaatcctaactgagacattacaccgtttctcattagaaggagatgctcctgtctcctggacagagacgaagaaacagtcttttaaacagactggagagtttggggagaaacgcaagaacagcattctcaatccaatcaactctatacgaaagttctccattgtgcagaagactcccttacagatgaatggcatcgaagaggattctgatgagcctttagagagaaggctgtccttagtaccagattctgagcagggagaggcgatactgcctcgcatcagcgtgatcagcactggccccacgcttcaggcacgaaggcgccagtctgtcctgaacctgatgacacactcagttaaccaaggtcagaacattcaccgaaagacaaccgcatccacaaggaaggtgtcactggcccctcaggcaaacttgactgaactggacatctactccagaaggttatctcaggagactggcttggagatcagtgaagagattaacgaagaggacttaaaggagtgcttctttgatgatatggagagcataccagcagtgactacatggaacacataccttaggtacatcactgtccacaagagcctgatcttcgtgctaatttggtgcttggtgatcttcctggcagaggtggctgcttctttggttgtgctgtggctccttggaaacactcctcttcaagacaaagggaatagtactcattccagcaacaattcctatgcagtgattatcaccagcaccagttcgtattatgtgttctacatttacgtgggagtagccgacactttgcttgctatgggattcttcagaggtctaccactggtgcatactctaatcacagtgtcgaagatcctgcatcacaagatgttacattctgttcttcaagcacctatgtcaaccctcaacacgttgaaggcaggtgggattctgaacaggttctccaaggatatagccatcctggatgaccttctgcctcttaccatctttgacttcatccagttgttactgatcgtgattggagctatagcagttgtcgcagtgttacaaccctacatcttcgttgcaacagtgccagtgatagtggctttcattatgttgagagcatatttcctccaaacctcacagcaactcaagcagctggaatctgaaggcaggagtccaattttcactcatcttgttacaagcctgaagggactctggacattgcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggagaaggagaaggaagagttggtattatcctgactttagccatgaacatcatgagtacattgcagtgggctgtgaactccagcatagatgtggatagcttgatgcgatctgtgagccgagtcttcaagttcattgacatgcccaccgagggtaagcctaccaagtccaccaagccctacaagaatggccaactctcgaaggttatgatcattgagaattcacacgtgaagaaagatgacatctggccctcagggggccaaatgactgtcaaagatctcacagccaagtacacagaaggtggaaatgccatcctggagaacatttccttcagcatcagtcctggccagagggtgggcctcttgggaagaactggatcagggaagagtactttgttatcagccttcttgagactactgaacactgaaggcgagatccagatcgatggtgtgtcttgggacagcatcactttgcaacagtggaggaaggccttcggcgtgataccacagaaggtgttcatcttctccggaaccttcaggaagaacttggatccctatgaacagtggagtgatcaggagatctggaaggttgcagatgaggttgggctcagatctgtgatagaacagtttcctgggaagcttgactttgtccttgtggatgggggctgtgtcctaagccacggccacaagcagttgatgtgcttggctagatctgttctcagtaaggcgaagatcttgctgcttgatgaacccagtgctcatttggatccagtaacataccagatcattcggagaactctgaagcaggcatttgctgattgcacagtaattctctgtgaacacaggatagaagcaatgctggaatgccaacagttcttggtcatcgaagagaacaaggtgcggcagtacgattccatccagaagctgctgaacgagaggagcctcttccggcaagccatcagcccctccgacagggtgaagctctttccccaccggaactcaagcaagtgcaagtctaagccccagatcgccgctctgaaggaagagactgaggaagaggtgcaggataccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 51 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggagccccctggagaaggccagcgtggtgagcaagctgttcttcagctggaccaggcccatcctgaggaagggctacaggcagaggctggagctgagcgacatctaccagatccccagcgtggacagcgccgacaacctgagcgagaagctggagagggagtgggacagggagctggccagcaagaagaaccccaagctgatcaacgccctgcggaggtgcttcttctggaggttcatgttctacggcatcttcctgtacctgggcgaggtgaccaaggccgtgcagcccctgctgctgggcaggatcatcgccagctacgaccccgacaacaaggaggagaggagcatcgccatctacctgggcatcggcctgtgcctgctgttcatcgtgaggaccctgctgctgcaccccgccatcttcggcctgcaccacatcggcatgcagatgaggatcgccatgttcagcctgatctacaagaagaccctgaagctgagcagcagggtgctggacaagatcagcatcggccagctggtgagcctgctgagcaacaacctgaacaagttcgacgagggcctggccctggcccacttcgtgtggatcgcccccctgcaggtggccctgctgatgggcctgatctgggagctgctgcaggccagcgccttctgcggcctgggcttcctgatcgtgctggccctgttccaggccggcctgggcaggatgatgatgaagtacagggaccagagggccggcaagatcagcgagaggctggtgatcaccagcgagatgatcgagaacatccagagcgtgaaggcctactgctgggaggaggccatggagaagatgatcgagaacctgaggcagaccgagctgaagctgacccggaaggccgcctacgtgaggtacttcaacagcagcgccttcttcttcagcggcttcttcgtggtgttcctgagcgtgctgccctacgccctgatcaagggcatcatcctgcggaagatcttcaccaccatcagcttctgcatcgtgctgaggatggccgtgacccggcagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagggcttcggcgagctgttcgagaaggccaagcagaacaacaacaacaggaagaccagcaacggcgacgacagcctgttcttcagcaacttcagcctgctgggcacccccgtgctgaaggacatcaacttcaagatcgagaggggccagctgctggccgtggccggcagcaccggcgccggcaagaccagcctgctgatggtgatcatgggcgagctggagcccagcgagggcaagatcaagcacagcggcaggatcagcttctgcagccagttcagctggatcatgcccggcaccatcaaggagaacatcatcttcggcgtgagctacgacgagtacaggtacaggagcgtgatcaaggcctgccagctggaggaggacatcagcaagttcgccgagaaggacaacatcgtgctgggcgagggcggcatcaccctgagcggcggccagagggccaggatcagcctggccagggccgtgtacaaggacgccgacctgtacctgctggacagccccttcggctacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagaggaggaacagcatcctgaccgagaccctgcacaggttcagcctggagggcgacgcccccgtgagctggaccgagaccaagaagcagagcttcaagcagaccggcgagttcggcgagaagaggaagaacagcatcctgaaccccatcaacagcatcaggaagttcagcatcgtgcagaagacccccctgcagatgaacggcatcgaggaggacagcgacgagcccctggagaggaggctgagcctggtgcccgacagcgagcagggcgaggccatcctgcccaggatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccccaggccaacctgaccgagctggacatctacagcaggaggctgagccaggagaccggcctggagatcagcgaggagatcaacgaggaggacctgaaggagtgcttcttcgacgacatggagagcatccccgccgtgaccacctggaacacctacctgaggtacatcaccgtgcacaagagcctgatcttcgtgctgatctggtgcctggtgatcttcctggccgaggtggccgccagcctggtggtgctgtggctgctgggcaacacccccctgcaggacaagggcaacagcacccacagcaggaacaacagctacgccgtgatcatcaccagcaccagcagctactacgtgttctacatctacgtgggcgtggccgacaccctgctggccatgggcttcttcaggggcctgcccctggtgcacaccctgatcaccgtgagcaagatcctgcaccacaagatgctgcacagcgtgctgcaggcccccatgagcaccctgaacaccctgaaggccggcggcatcctgaacaggttcagcaaggacatcgccatcctggacgacctgctgcccctgaccatcttcgacttcatccagctgctgctgatcgtgatcggcgccatcgccgtggtggccgtgctgcagccctacatcttcgtggccaccgtgcccgtgatcgtggccttcatcatgctgagggcctacttcctgcagaccagccagcagctgaagcagctggagagcgagggcaggagccccatcttcacccacctggtgaccagcctgaagggcctgtggaccctgagggccttcggccggcagccctacttcgagaccctgttccacaaggccctgaacctgcacaccgccaactggttcctgtacctgagcaccctgaggtggttccagatgaggatcgagatgatcttcgtgatcttcttcatcgccgtgaccttcatcagcatcctgaccaccggcgagggcgagggcagggtgggcatcatcctgaccctggccatgaacatcatgagcaccctgcagtgggccgtgaacagcagcatcgacgtggacagcctgatgaggagcgtgagcagggtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggcaggaccggcagcggcaagagcaccctgctgagcgccttcctgaggctgctgaacaccgagggcgagatccagatcgacggcgtgagctgggacagcatcaccctgcagcagtggaggaaggccttcggcgtgatcccccagaaggtgttcatcttcagcggcaccttcaggaagaacctggacccctacgagcagtggagcgaccaggagatctggaaggtggccgacgaggtgggcctgaggagcgtgatcgagcagttccccggcaagctggacttcgtgctggtggacggcggctgcgtgctgagccacggccacaagcagctgatgtgcctggccaggagcgtgctgagcaaggccaagatcctgctgctggacgagcccagcgcccacctggaccccgtgacctaccagatcatcaggaggaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 52 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggtcgcccctggagaaggccagcgtggtgtccaagctgttcttcagctggaccaggcccatcctgaggaagggctacaggcagaggctggagctgtcagacatctaccagatcccctctgtggacagcgctgacaacctgtctgagaagctggagagggagtgggacagggagctggccagcaagaagaaccccaagctgatcaacgccctgcggaggtgcttcttctggaggttcatgttctacggaatcttcctgtacctgggggaggtgaccaaggccgtgcagcccctgctgctgggaaggatcatcgcctcctacgaccccgacaacaaggaggagaggagcatcgccatctacctgggcatcggcctgtgcctgctgttcatcgtgaggaccctgctgctgcaccccgccatcttcggcctgcaccacatcggaatgcagatgaggatcgccatgttcagcctgatctacaagaagaccctgaagctgtcaagcagggtgctggacaagatcagtatcggacagctggtgagtctgctgtccaacaacctgaacaagttcgacgagggactggccctggcccacttcgtgtggatcgctcccctgcaggtggccctgctgatggggctgatctgggagctgctgcaggccagcgccttctgcggcctgggcttcctgatcgtgctggccctgttccaggccggcctgggcaggatgatgatgaagtacagggaccagagggctggcaagatcagcgagaggctggtgatcacctcagagatgatcgagaacatccagagcgtgaaggcatactgctgggaggaggccatggagaagatgatcgagaacctgaggcagaccgagctgaagctgacccggaaggccgcctacgtgaggtacttcaacagcagcgccttcttcttctcagggttcttcgtggtgttcctgtctgtgctgccctacgccctgatcaagggcatcatcctgcggaagatcttcaccaccatctcattctgcatcgtgctgaggatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacaggaagaccagcaacggcgacgacagcctgttcttcagcaacttcagcctgctgggcacccccgtgctgaaggacatcaacttcaagatcgagaggggacagctgctggccgtggccggaagcaccggagccggcaagacctcactgctgatggtgatcatgggagagctggagccctcagagggcaagatcaagcacagtggaaggatctcattctgctctcagttcagctggatcatgcccggcaccatcaaggagaacatcatcttcggtgtgtcctacgacgagtacaggtacaggagcgtgatcaaggcctgccagctggaggaggacatcagcaagttcgcagagaaggacaacatcgtgctgggagagggtggcatcaccctgagcggaggccagagggccaggatcagcctggcaagggcagtgtacaaggacgctgacctgtacctgctggacagccccttcggatacctggacgtgctgaccgagaaggagatcttcgagagctgcgtgtgcaagctgatggccaacaagaccaggatcctggtgacctctaagatggagcacctgaagaaggctgacaagatcctgatcctgcacgagggcagcagctacttctacgggaccttcagcgagctgcagaacctgcagcccgacttcagcagcaagctgatgggctgcgacagcttcgaccagttcagcgccgagaggaggaacagcatcctgaccgagaccctgcacaggttcagcctggagggcgacgcccccgtgagctggaccgagaccaagaagcagagcttcaagcagaccggagagttcggcgagaagaggaagaacagcatcctgaaccccatcaacagcatcaggaagttcagcatcgtgcagaagacccccctgcagatgaacggcatcgaggaggacagcgacgagcccctggagaggaggctgtccctggtgcccgacagcgagcagggcgaggccatcctgcccaggatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccccaggccaacctgaccgagctggacatctacagcaggaggctgagccaggagaccggcctggagatcagcgaggagatcaacgaggaggacctgaaggagtgcttcttcgacgacatggagagcatccccgccgtgaccacctggaacacctacctgaggtacatcaccgtgcacaagagcctgatcttcgtgctgatctggtgcctggtgatcttcctggccgaggtggccgccagcctggtggtgctgtggctgctgggcaacacccccctgcaggacaagggcaacagcacccacagcaggaacaacagctacgccgtgatcatcaccagcaccagcagctactacgtgttctacatctacgtgggagtggccgacaccctgctggccatgggcttcttcaggggtctgcccctggtgcacaccctgatcaccgtgagcaagatcctgcaccacaagatgctgcacagcgtgctgcaggcccccatgagcaccctgaacaccctgaaggccggtgggatcctgaacaggttcagcaaggacatcgccatcctggacgacctgctgcccctgaccatcttcgacttcatccagctgctgctgatcgtgatcggagccatcgccgtggtggccgtgctgcagccctacatcttcgtggccaccgtgcccgtgatcgtggccttcatcatgctgagggcctacttcctgcagaccagccagcagctgaagcagctggagtctgagggcaggagtcccatcttcacccacctggtgaccagcctgaagggactgtggaccctgagggccttcggccggcagccctacttcgagaccctgttccacaaggctctgaacctgcacaccgccaactggttcctgtacctgagcaccctgaggtggttccagatgaggatcgagatgatcttcgtgatcttcttcatcgccgtgaccttcatctccatcctgaccaccggcgagggagagggaagggtgggcatcatcctgaccctggccatgaacatcatgagcaccctgcagtgggctgtgaacagcagcatcgacgtggacagcctgatgaggagcgtgagcagggtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttctcaatcagccccggccagagggtgggcctgctgggaaggaccggctcaggcaagagcaccctgctgagcgccttcctgaggctgctgaacaccgagggcgagatccagatcgacggcgtgagctgggactcaatcaccctgcagcagtggaggaaggccttcggcgtgatcccccagaaggtgttcatcttctctggaaccttcaggaagaacctggacccctacgagcagtggagcgaccaggagatctggaaggtggccgacgaggtgggcctgaggagcgtgatcgagcagttccccggcaagctggacttcgtgctggtggacgggggctgcgtgctgagccacggccacaagcagctgatgtgcctggccaggagcgtgctgagcaaggccaagatcctgctgctggacgagcccagtgcccacctggaccccgtgacctaccagatcatcaggaggaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 53 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggtcgcctctggagaaggccagcgtggtgtccaagctgttcttcagctggaccagaccaatcctgaggaagggctacagacagcgcctggagctgtcagacatctaccagatcccttctgtggactctgctgacaacctgtctgagaagctggagagagagtgggacagagagctggccagcaagaagaaccctaagctgatcaacgccctgcggaggtgcttcttctggagattcatgttctacggaatcttcctgtacctgggggaggtgaccaaggccgtgcagcctctgctgctgggaagaatcatcgcctcctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagtatcggacagctggtgagtctgctgtccaacaacctgaacaagttcgacgagggactggccctggcccacttcgtgtggatcgctcctctgcaggtggccctgctgatggggctgatctgggagctgctgcaggcctctgccttctgcggcctgggcttcctgatcgtgctggccctgttccaggccggcctgggcagaatgatgatgaagtacagagaccagagagctggcaagatcagcgagagactggtgatcacctcagagatgatcgagaacatccagtctgtgaaggcatactgctgggaggaggccatggagaagatgatcgagaacctgagacagaccgagctgaagctgacccggaaggccgcctacgtgagatacttcaacagcagcgccttcttcttctcagggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccctgtgctgaaggacatcaacttcaagatcgagagaggacagctgctggccgtggccggatccaccggagccggcaagacctcactgctgatggtgatcatgggagagctggagccttcagagggcaagatcaagcacagtggaagaatctcattctgctctcagttctcctggatcatgcctggcaccatcaaggagaacatcatcttcggtgtgtcctacgacgagtacagatacagaagcgtgatcaaggcctgccagctggaggaggacatctccaagttcgcagagaaggacaacatcgtgctgggagagggtggcatcaccctgagcggaggccagagggccagaatctctctggcaagagcagtgtacaaggacgctgacctgtacctgctggactctcctttcggatacctggacgtgctgaccgagaaggagatcttcgagagctgcgtgtgcaagctgatggccaacaagaccaggatcctggtgacctctaagatggagcacctgaagaaggctgacaagatcctgatcctgcacgagggcagcagctacttctacgggaccttcagcgagctgcagaacctgcagccagacttcagcagcaagctgatgggctgcgactctttcgaccagttcagcgccgagagaagaaacagcatcctgaccgagaccctgcacaggttcagcctggagggcgacgcccctgtgtcctggaccgagaccaagaagcagtctttcaagcagaccggagagttcggcgagaagaggaagaactctatcctgaacccaatcaactctatcaggaagttctccatcgtgcagaagacccccctgcagatgaacggcatcgaggaggactctgacgagcctctggagagaaggctgtccctggtgccagactctgagcagggcgaggccatcctgcctcgcatcagcgtgatcagcaccggccccaccctgcaggccaggaggaggcagtctgtgctgaacctgatgacccacagcgtgaaccagggccagaacatccacaggaagaccaccgcctccaccaggaaggtgagcctggcccctcaggccaacctgaccgagctggacatctacagcagaaggctgtctcaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgcctctctggtggtgctgtggctgctgggcaacacccctctgcaggacaagggcaacagcacccacagcagaaacaacagctacgccgtgatcatcaccagcaccagcagctactacgtgttctacatctacgtgggagtggccgacaccctgctggccatgggcttcttcagaggtctgccactggtgcacaccctgatcaccgtgagcaagatcctgcaccacaagatgctgcactctgtgctgcaggcccctatgagcaccctgaacaccctgaaggccggtgggatcctgaacagattctccaaggacatcgccatcctggacgacctgctgcctctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagtctgagggcaggagtccaatcttcacccacctggtgaccagcctgaagggactgtggaccctgagggccttcggccggcagccttacttcgagaccctgttccacaaggctctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggctgtgaactccagcatcgacgtggacagcctgatgaggtctgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatctccttctcaatcagccctggccagagggtgggcctgctgggaagaaccggctcaggcaagagcaccctgctgagcgccttcctgagactgctgaacaccgagggcgagatccagatcgacggcgtgtcttgggactcaatcaccctgcagcagtggaggaaggccttcggcgtgatcccacagaaggtgttcatcttctctggaaccttcagaaagaacctggacccctacgagcagtggagcgaccaggagatctggaaggtggccgacgaggtgggcctgagatctgtgatcgagcagttccctggcaagctggacttcgtgctggtggacgggggctgcgtgctgagccacggccacaagcagctgatgtgcctggccagatctgtgctgagcaaggccaagatcctgctgctggacgagcccagtgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagcccctccgacagggtgaagctgttcccccaccggaacagcagcaagtgcaagtctaagccccagatcgccgccctgaaggaggagaccgaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 54 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggtcgcctctggagaaggccagcgtggtgtccaagctgtttttcagctggaccagaccaatcctgaggaagggctacagacagcgcctggagctgtcagacatctaccagatcccttctgtggattctgctgacaatctgtctgagaagctggagagagagtgggatagagagctggccagcaagaagaatcctaagctgatcaatgccctgcggaggtgctttttctggagatttatgttctacggaatctttctgtacctgggggaggtgaccaaggccgtgcagcctctgctgctgggaagaatcatcgcctcctacgaccccgataacaaggaggagcgctctatcgccatctacctgggcatcggcctgtgcctgctgtttatcgtgaggacactgctgctgcacccagccatctttggcctgcaccacatcggaatgcagatgagaatcgccatgtttagcctgatctacaagaagaccctgaagctgtcaagcagggtgctggataagatcagtatcggacagctggtgagtctgctgtccaacaacctgaacaagtttgatgagggactggccctggcccacttcgtgtggatcgctcctctgcaggtggccctgctgatggggctgatctgggagctgctgcaggcctctgccttctgcggcctgggcttcctgatcgtgctggccctgtttcaggccgggctggggagaatgatgatgaagtacagagatcagagagctgggaagatcagcgagagactggtgatcacctcagagatgatcgagaatatccagtctgtgaaggcatactgctgggaggaggccatggagaagatgatcgagaacctgagacagacagagctgaagctgacccggaaggccgcctacgtgagatacttcaatagcagcgccttcttcttctcagggttctttgtggtgtttctgtctgtgctgccctacgccctgatcaagggcatcatcctgcggaagatcttcaccaccatctcattctgcatcgtgctgcgcatggccgtgacccggcagtttccctgggccgtgcagacatggtacgactctctgggagccatcaacaagatccaggatttcctgcagaagcaggagtacaagacactggagtacaacctgaccaccacagaggtggtgatggagaatgtgacagccttctgggaggagggatttggggagctgtttgagaaggccaagcagaacaataacaatagaaagacctctaatggcgatgacagcctgttcttcagtaatttcagcctgctgggcacccctgtgctgaaggatatcaatttcaagatcgagagaggacagctgctggccgtggccggatccaccggagccggcaagacctcactgctgatggtgatcatgggagagctggagccttcagagggcaagatcaagcacagtggaagaatctcattctgctctcagttttcctggatcatgcctggcaccatcaaggagaatatcatctttggtgtgtcctacgatgagtacagatacagaagcgtgatcaaggcctgccagctggaggaggacatctccaagtttgcagagaaggacaatatcgtgctgggagagggtggcatcacactgagcggaggccagagggccagaatctctctggcaagagcagtgtacaaggatgctgatctgtacctgctggactctccttttggatacctggatgtgctgacagagaaggagatctttgagagctgcgtgtgcaagctgatggccaacaagaccaggatcctggtgacctctaagatggagcacctgaagaaggctgacaagatcctgatcctgcacgagggcagcagctacttttacgggacatttagcgagctgcagaatctgcagccagactttagcagcaagctgatgggctgcgattctttcgaccagtttagcgccgagagaagaaatagcatcctgaccgagaccctgcacaggttcagcctggagggcgatgcccctgtgtcctggacagagacaaagaagcagtcttttaagcagaccggagagtttggggagaagaggaagaattctatcctgaatccaatcaactctatcaggaagttttccatcgtgcagaagacccccctgcagatgaatggcatcgaggaggattctgatgagcctctggagagaaggctgtccctggtgccagattctgagcagggcgaggccatcctgcctcgcatcagcgtgatcagcaccggccccaccctgcaggccaggaggaggcagtctgtgctgaacctgatgacacacagcgtgaaccagggccagaacatccacaggaagacaacagcctccacaaggaaggtgagcctggcccctcaggccaacctgaccgagctggatatctacagcagaaggctgtctcaggagaccggcctggagatcagtgaggagatcaacgaggaggacctgaaggagtgcttttttgatgatatggagagcatcccagccgtgaccacatggaacacatacctgaggtacatcaccgtgcacaagagcctgatctttgtgctgatctggtgcctggtgatctttctggccgaggtggccgcctctctggtggtgctgtggctgctgggcaacacccctctgcaggacaaggggaatagtacccacagcagaaataacagctacgccgtgatcatcaccagcaccagtagctactacgtgttttacatctacgtgggagtggccgacaccctgctggccatgggcttcttcagaggtctgccactggtgcacaccctgatcacagtgagcaagatcctgcaccacaagatgctgcactctgtgctgcaggcccctatgagcaccctgaacaccctgaaggccggtgggatcctgaatagattctccaaggatatcgccatcctggatgacctgctgcctctgaccatctttgacttcatccagctgctgctgatcgtgatcggagccatcgccgtggtggccgtgctgcagccctacatctttgtggccacagtgccagtgatcgtggcctttatcatgctgagagcctacttcctgcagaccagccagcagctgaagcagctggagtctgagggcaggagtccaatcttcacccacctggtgacaagcctgaagggactgtggacactgagggccttcggccggcagccttactttgagaccctgttccacaaggctctgaatctgcacaccgccaactggttcctgtacctgagcacactgcgctggttccagatgagaatcgagatgatctttgtgatcttcttcatcgccgtgaccttcatctccatcctgacaacaggcgagggagagggaagagtgggcatcatcctgaccctggccatgaatatcatgagcacactgcagtgggctgtgaactccagcatcgatgtggatagcctgatgaggtctgtgagcagggtgtttaagttcatcgacatgccaacagagggcaagcctaccaagagcaccaagccatacaagaatggccagctgagcaaggtgatgatcatcgagaatagccacgtgaagaaggatgacatctggcccagcgggggccagatgaccgtgaaggatctgacagccaagtacacagagggcggcaatgccatcctggagaacatctccttctcaatcagccctggccagagggtgggcctgctgggaagaaccggctcagggaagagtaccctgctgagcgcctttctgagactgctgaacaccgagggcgagatccagatcgatggcgtgtcttgggattcaatcaccctgcagcagtggaggaaggcctttggcgtgatcccacagaaggtgtttatcttttctggaacatttagaaagaacctggatccctacgagcagtggagcgatcaggagatctggaaggtggccgatgaggtggggctgagatctgtgatcgagcagtttcctgggaagctggactttgtgctggtggatgggggctgcgtgctgagccacggccacaagcagctgatgtgcctggccagatctgtgctgagtaaggccaagatcctgctgctggatgagcccagtgcccacctggatccagtgacataccagatcatcagaagaaccctgaagcaggcctttgccgattgcacagtgatcctgtgcgagcacaggatcgaggccatgctggagtgccagcagtttctggtgatcgaggagaacaaggtgcggcagtacgattccatccagaagctgctgaacgagaggagcctgttccggcaggccatcagcccctccgacagggtgaagctgtttccccaccggaacagcagcaagtgcaagtctaagccccagatcgccgccctgaaggaggagacagaggaggaggtgcaggatacaaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 55 - RNA, 4746 nt, synthetic construct
  misc_feature 1..4746: note = Synthetic construct
  source 1..4746: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccatgggccagcgcagccccctcgagaaggccagcgtggtgagcaagctgttcttcagctggacccgccccatcctgcgcaagggctaccgccagcgcctggagctgagcgacatctaccagatccccagcgtggacagcgccgacaacctgagcgagaagctggagcgcgagtgggaccgcgagctggccagcaagaagaaccccaagctgatcaacgccctgcgccgctgcttcttctggcgcttcatgttctacggcatcttcctgtacctgggcgaggtgaccaaggccgtgcagcccctgctgctgggccgcatcatcgccagctacgaccccgacaacaaggaggagcgcagcatcgccatctacctgggcatcggcctgtgcctgctgttcatcgtgcgcaccctgctgctgcaccccgccatcttcggcctgcaccacatcggcatgcagatgcgcatcgccatgttcagcctgatctacaagaagaccctgaagctgagcagccgcgtgctggacaagatcagcatcggccagctggtgagcctgctgagcaacaacctgaacaagttcgacgagggcctggccctggcccacttcgtgtggatcgcccccctgcaggtggccctgctgatgggcctgatctgggagctgctgcaggccagcgccttctgcggcctgggcttcctgatcgtgctggccctgttccaggccggcctgggccgcatgatgatgaagtaccgcgaccagcgcgccggcaagatcagcgagcgcctggtgatcaccagcgagatgatcgagaacatccagagcgtgaaggcctactgctgggaggaggccatggagaagatgatcgagaacctgcgccagaccgagctgaagctgacccgcaaggccgcctacgtgcgctacttcaacagcagcgccttcttcttcagcggcttcttcgtggtgttcctgagcgtgctgccctacgccctgatcaagggcatcatcctgcgcaagatcttcaccaccatcagcttctgcatcgtgctgcgcatggccgtgacccgccagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagggcttcggcgagctgttcgagaaggccaagcagaacaacaacaaccgcaagaccagcaacggcgacgacagcctgttcttcagcaacttcagcctgctgggcacccccgtgctgaaggacatcaacttcaagatcgagcgcggccagctgctggccgtggccggcagcaccggcgccggcaagaccagcctgctgatggtgatcatgggcgagctggagcccagcgagggcaagatcaagcacagcggccgcatcagcttctgcagccagttcagctggatcatgcccggcaccatcaaggagaacatcatcttcggcgtgagctacgacgagtaccgctaccgcagcgtgatcaaggcctgccagctggaggaggacatcagcaagttcgccgagaaggacaacatcgtgctgggcgagggcggcatcaccctgagcggcggccagcgcgcccgcatcagcctggcccgcgccgtgtacaaggacgccgacctgtacctgctggacagccccttcggctacctggacgtgctgaccgagaaggagatcttcgagagctgcgtgtgcaagctgatggccaacaagacccgcatcctggtgaccagcaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagcgccgcaacagcatcctgaccgagaccctgcaccgcttcagcctggagggcgacgcccccgtgagctggaccgagaccaagaagcagagcttcaagcagaccggcgagttcggcgagaagcgcaagaacagcatcctgaaccccatcaacagcatccgcaagttcagcatcgtgcagaagacccccctgcagatgaacggcatcgaggaggacagcgacgagcccctggagcgccgcctgagcctggtgcccgacagcgagcagggcgaggccatcctgccccgcatcagcgtgatcagcaccggccccaccctgcaggcccgccgccgccagagcgtgctgaacctgatgacccacagcgtgaaccagggccagaacatccaccgcaagaccaccgccagcacccgcaaagtgagcctggccccccaggccaacctgaccgagctggacatctacagccgccgcctgagccaggagaccggcctggagatcagcgaggagatcaacgaggaggacctgaaggagtgcttcttcgacgacatggagagcatccccgccgtgaccacctggaacacctacctgcgctacatcaccgtgcacaagagcctgatcttcgtgctgatctggtgcctggtgatcttcctggccgaggtggccgccagcctggtggtgctgtggctgctgggcaacacccccctgcaggacaagggcaacagcacccacagccgcaacaacagctacgccgtgatcatcaccagcaccagcagctactacgtgttctacatctacgtgggcgtggccgacaccctgctggccatgggcttcttccgcggcctgcccctggtgcacaccctgatcaccgtgagcaagatcctgcaccacaagatgctgcacagcgtgctgcaggcccccatgagcaccctgaacaccctgaaggccggcggcatcctgaaccgcttcagcaaggacatcgccatcctggacgacctgctgcccctgaccatcttcgacttcatccagctgctgctgatcgtgatcggcgccatcgccgtggtggccgtgctgcagccctacatcttcgtggccaccgtgcccgtgatcgtggccttcatcatgctgcgcgcctacttcctgcagaccagccagcagctgaagcagctggagagcgagggccgcagccccatcttcacccacctggtgaccagcctgaagggcctgtggaccctgcgcgccttcggccgccagccctacttcgagaccctgttccacaaggccctgaacctgcacaccgccaactggttcctgtacctgagcaccctgcgctggttccagatgcgcatcgagatgatcttcgtgatcttcttcatcgccgtgaccttcatcagcatcctgaccaccggcgagggcgagggccgcgtgggcatcatcctgaccctggccatgaacatcatgagcaccctgcagtgggccgtgaacagcagcatcgacgtggacagcctgatgcgcagcgtgagccgcgtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagcgcgtgggcctgctgggccgcaccggcagcggcaagagcaccctgctgagcgccttcctgcgcctgctgaacaccgagggcgagatccagatcgacggcgtgagctgggacagcatcaccctgcagcagtggcgcaaggccttcggcgtgatcccccagaaggtgttcatcttcagcggcaccttccgcaagaacctggacccctacgagcagtggagcgaccaggagatctggaaggtggccgacgaggtgggcctgcgcagcgtgatcgagcagttccccggcaagctggacttcgtgctggtggacggcggctgcgtgctgagccacggccacaagcagctgatgtgcctggcccgcagcgtgctgagcaaggccaagatcctgctgctggacgagcccagcgcccacctggaccccgtgacctaccagatcatccgccgcaccctgaagcaggccttcgccgactgcaccgtgatcctgtgcgagcaccgcatcgaggccatgctggagtgccagcagttcctggtgatcgaggagaacaaggtgcgccagtacgacagcatccagaagctgctgaacgagcgcagcctgttccgccaggccatcagccccagcgaccgcgtgaagcttttcccccaccgcaacagcagcaagtgcaagagcaagccccagatcgccgccctgaaggaggagaccgaggaggaggtgcaggacacccgcctgtagctcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 56 - RNA, 4752 nt, synthetic construct
  misc_feature 1..4752: note = Synthetic construct
  source 1..4752: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccatgcagaggagccccctggagaaggctagcgtggtgagcaagctgttcttcagctggaccaggcccatcctgaggaagggctacaggcagaggctggagctgagcgacatctaccagatccccagcgtggacagcgccgacaacctgagcgagaagctggagagggagtgggacagggagctggccagcaagaagaaccccaagctgatcaacgccctgcggaggtgcttcttctggaggttcatgttctacggcatcttcctgtacctgggcgaggtgaccaaggccgtgcagcccctgctgctgggcaggatcatcgccagctacgaccccgacaacaaggaggagaggagcatcgccatctacctgggcatcggcctgtgcctgctgttcatcgtgaggaccctgctgctgcaccccgccatcttcggcctgcaccacatcggcatgcagatgaggatcgccatgttcagcctgatctacaagaagaccctgaagctgagcagcagggtgctggacaagatcagcatcggccagctggtgagcctgctgagcaacaacctgaacaagttcgacgagggcctggccctggcccacttcgtgtggatcgcccccctgcaggtggccctgctgatgggcctgatctgggagctgctgcaggccagcgccttctgcggcctgggcttcctgatcgtgctggccctgttccaggccggcctgggcaggatgatgatgaagtacagggaccagagggccggcaagatcagcgagaggctggtgatcaccagcgagatgatcgagaacatccagagcgtgaaggcctactgctgggaggaggccatggagaagatgatcgagaacctgaggcagaccgagctgaagctgacccggaaggccgcctacgtgaggtacttcaacagcagcgccttcttcttcagcggcttcttcgtggtgttcctgagcgtgctgccctacgccctgatcaagggcatcatcctgcggaagatcttcaccaccatcagcttctgcatcgtgctgaggatggccgtgacccggcagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagggcttcggcgagctgttcgagaaggccaagcagaacaacaacaacaggaagaccagcaacggcgacgacagcctgttcttcagcaacttcagcctgctgggcacccccgtgctgaaggacatcaacttcaagatcgagaggggccagctgctggccgtggccggcagcaccggcgccggcaagaccagcctgctgatggtgatcatgggcgagctggagcccagcgagggcaagatcaagcacagcggcaggatcagcttctgcagccagttcagctggatcatgcccggcaccatcaaggagaacatcatcttcggcgtgagctacgacgagtacaggtacaggagcgtgatcaaggcctgccagctggaggaggacatcagcaagttcgccgagaaggacaacatcgtgctgggcgagggcggcatcaccctgagcggcggccagagggccaggatcagcctggccagggccgtgtacaaggacgccgacctgtacctgctggacagccccttcggctacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagaggaggaacagcatcctgaccgagacactgcacaggttcagcctggagggcgacgcccccgtgagctggaccgagacaaagaagcagagcttcaagcagaccggcgagttcggcgagaagaggaagaacagcatcctgaaccccatcaacagcatcaggaagttcagcatcgtgcagaagacccccctgcagatgaacggcatcgaggaggacagcgacgagcccctggagaggaggctgagcctggtgcccgacagcgagcagggcgaggccatcctgcccaggatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccccaggccaacctgaccgagctggacatctacagcaggaggctgagccaggagacaggcctggagatcagcgaggagatcaacgaggaggacctgaaggagtgcttcttcgacgacatggagagcatccccgccgtgaccacctggaacacctacctgaggtacatcaccgtgcacaagagcctgatcttcgtgctgatctggtgcctggtgatcttcctggccgaggtggccgccagcctggtggtgctgtggctgctgggcaacacccccctgcaggacaagggcaacagcacccacagcaggaacaacagctacgccgtgatcatcaccagcaccagcagctactacgtgttctacatctacgtgggcgtggccgacaccctgctggccatgggcttcttcaggggcctgcccctggtgcacaccctgatcaccgtgagcaagatcctgcaccacaagatgctgcacagcgtgctgcaggcccccatgagcaccctgaacaccctgaaggccggcggcatcctgaacaggttcagcaaggacatcgccatcctggacgacctgctgcccctgaccatcttcgacttcatccagctgctgctgatcgtgatcggcgccatcgccgtggtggccgtgctgcagccctacatcttcgtggccaccgtgcccgtgatcgtggccttcatcatgctgagggcctacttcctgcagaccagccagcagctgaagcagctggagagcgagggcaggagccccatcttcacccacctggtgaccagcctgaagggcctgtggaccctgagggccttcggccggcagccctacttcgagacactgttccacaaggccctgaacctgcacaccgccaactggttcctgtacctgagcaccctgaggtggttccagatgaggatcgagatgatcttcgtgatcttcttcatcgccgtgaccttcatcagcatcctgaccaccggcgagggcgagggcagggtgggcatcatcctgaccctggccatgaacatcatgagcaccctgcagtgggccgtgaacagcagcatcgacgtggacagcctgatgaggagcgtgagcagggtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggcaggaccggcagcggcaagagcaccctgctgagcgccttcctgaggctgctgaacaccgagggcgagatccagatcgacggcgtgagctgggacagcatcaccctgcagcagtggaggaaggccttcggcgtgatcccccagaaggtgttcatcttcagcggcaccttcaggaagaacctggacccctacgagcagtggagcgaccaggagatctggaaggtggccgacgaggtgggcctgaggagcgtgatcgagcagttccccggcaagctggacttcgtgctggtggacggcggctgcgtgctgagccacggccacaagcagctgatgtgcctggccaggagcgtgctgagcaaggccaagatcctgctgctggacgagcccagcgcccacctggaccccgtgacctaccagatcatcaggaggaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagacagaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 57 - RNA, 4752 nt, synthetic construct
  misc_feature 1..4752: note = Synthetic construct
  source 1..4752: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccatgcagaggtcccccttggaaaaagcctccgtggtgtctaaattgttcttctcctggacaaggcccatattgaggaaaggatacaggcagaggttggaattgtccgacatataccagataccctccgtggactccgccgacaacttgtccgaaaaattggaaagggaatgggatagggaattggcctccaaaaaaaaccccaaattgataaacgccttgaggaggtgcttcttctggaggttcatgttctacggaatattcttgtacttgggagaagtgacaaaagccgtgcagcccttgttgttgggaaggataatagcctcctacgaccccgacaacaaagaagaaaggtccatagccatatacttgggaataggattgtgcttgttgttcatagtgaggacattgttgttgcaccccgccatattcggattgcaccacataggaatgcagatgaggatagccatgttctccttgatatacaaaaaaacattgaaattgtcctccagggtgttggacaaaatatccataggacagttggtgtccttgttgtccaacaacttgaacaaattcgacgaaggattggccttggcccacttcgtgtggatagcccccttgcaggtggccttgttgatgggattgatatgggaattgttgcaggcctccgccttctgcggattgggattcttgatagtgttggccttgttccaggccggattgggaaggatgatgatgaaatatagggaccagagggccggaaaaatatccgaaaggttggtgataacatccgaaatgatagaaaacatacagtccgtgaaagcctactgctgggaagaagccatggaaaaaatgatagaaaacttgaggcagacagaattgaaattgacaaggaaagccgcctacgtgaggtacttcaactcctccgccttcttcttctccggattcttcgtggtgttcttgtccgtgttgccctacgccttgataaaaggaataatattgaggaaaatattcacaacaatatccttctgcatagtgttgaggatggccgtgacaaggcagttcccctgggccgtgcagacatggtatgactccttgggagccataaacaaaatacaggacttcttgcagaaacaggaatacaaaacattggaatacaacttgacaacaacagaagtggtgatggaaaacgtgacagccttctgggaagaaggattcggagaattgttcgaaaaagccaaacagaacaacaacaacaggaaaacatccaacggagacgactccttgttcttctccaacttctccttgttgggaacacccgtgttgaaagacataaacttcaaaatagaaaggggacagttgttggccgtggccggatccacaggagccggaaaaacatccttgttgatggtgataatgggagaattggaaccctccgaaggaaaaataaaacactccggaaggatatccttctgctcccagttctcctggataatgcccggaacaataaaagaaaacataatattcggagtgtcctacgacgaatacaggtacaggtccgtgataaaagcctgccagttggaagaagacatatccaaattcgccgaaaaagacaacatagtgttgggagaaggaggaataacattgtccggaggacagagggccaggatatccttggccagggccgtgtacaaagacgccgacttgtacttgttggactcccccttcggatacttggacgtgttgacagaaaaagaaatattcgaatcctgcgtgtgcaaattgatggccaacaaaacaaggatattggtgacatccaaaatggaacacttgaaaaaagccgacaaaatattgatattgcacgaaggatcctcctacttctacggaacattctccgaattgcagaacttgcagcccgacttctcctccaaattgatgggatgcgactcctttgaccagttctccgccgaaaggaggaactccatattgacagaaacattgcacaggttctccttggaaggagacgcccccgtgtcctggacagaaacaaaaaaacagtccttcaaacagacaggagaattcggagaaaaaaggaaaaactccatattgaaccccataaactccataaggaaattctccatagtgcagaaaacacccttgcagatgaacggaatagaagaagactccgacgaacccttggaaaggaggttgtccttggtgcccgactccgaacagggagaagccatattgcccaggatatccgtgatatccacaggacccacattgcaggccaggaggaggcagtccgtgttgaacttgatgacacactccgtgaaccagggacagaacatacacaggaaaacaacagcctccacaaggaaagtgtccttggccccccaggccaacttgacagaattggacatatactccaggaggttgtcccaggaaacaggattggaaatatccgaagaaataaacgaagaagacttgaaagaatgcttcttcgatgacatggaatccatacccgccgtgacaacatggaacacatacttgaggtacataacagtgcataaatccttgatattcgtgttgatatggtgcttggtgatattcttggctgaagtggccgcctccttggtggtgttgtggttgttgggaaacacacccttgcaggacaaaggaaactccacacactcctccaacaactcctacgccgtgataataacatccacatcctcctactacgtgttctacatatacgtgggagtggccgacacattgttggccatgggattcttcaggggattgcccttggtgcacacattgataacagtgtccaaaatattgcaccacaaaatgttgcactccgtgttgcaggcccccatgtccacattgaacacattgaaagccggaggaatattgaacaggttctccaaagacatagccatattggacgacttgttgcccttgacaatattcgacttcatacagttgttgttgatagtgataggagccatagccgtggtggccgtgttgcagccctacatattcgtggccacagtgcccgtgatagtggccttcataatgttgagggcctacttcttgcagacatcccagcagttgaaacagttggaatccgaaggaaggtcccccatattcacacacttggtgacatccttgaaaggattgtggacattgagggccttcggaaggcagccctacttcgaaacattgttccacaaagccttgaacttgcacacagccaactggttcttgtacttgtccacattgaggtggttccagatgaggatagaaatgatattcgtgatattcttcatagccgtgacattcatatccatattgacaacaggagaaggagaaggaagggtgggaataatattgacattggccatgaacataatgtccacattgcagtgggccgtgaactcctccatagacgtggactccttgatgaggtccgtgtccagggtgttcaaattcatagacatgcccacagaaggaaaacccacaaaatccacaaaaccctacaaaaacggacagttgtccaaagtgatgataatagaaaactcccacgtgaaaaaagacgacatatggccctccggaggacagatgacagtgaaagacttgacagccaaatacacagaaggaggaaacgccatattggaaaacatatccttctccatatcccccggacagagggtgggattgttgggaaggacaggatccggaaaatccacattgttgtccgccttcttgaggttgttgaacacagaaggagaaatacagatagacggagtgtcctgggactccataacattgcagcagtggaggaaagccttcggagtgataccccagaaagtgttcatattctccggaacattcaggaaaaacttggacccctacgaacagtggtccgaccaggaaatatggaaagtggccgacgaagtgggattgaggtccgtgatagaacagttccccggaaaattggacttcgtgttggtggacggaggatgcgtgttgtcccacggacacaaacagttgatgtgcttggccaggtccgtgttgtccaaagccaaaatattgttgttggacgaaccctccgcccacttggaccccgtgacataccagataataaggaggacattgaaacaggccttcgccgactgcacagtgatattgtgcgaacacaggatagaagccatgttggaatgccagcagttcttggtgatagaagaaaacaaagtgaggcagtacgactccatacagaaattgttgaacgaaaggtccttgttcaggcaggccatatccccctccgacagggtgaaattgttcccccacaggaactcctccaaatgcaaatccaaaccccagatagccgccttgaaagaagaaacagaagaagaagtgcaggacacaaggttgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 58 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggagccccctggagaaggctagcgtggtgagcaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagagcttcaagcagaccggagagttcggcgagaagaggaagaacagcatcctgaacccaatcaacagcatcaggaagttcagcatcgtgcagaagaccccactgcagatgaacggcatcgaggaggacagcgacgagcccctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 59 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggagccccctggagaaggctagcgtggtcagcaagctgttcttcagctggaccagaccaatcctgaggaaaggatacagacagcgcctggaactgagcgacatataccaaatccccagcgtggacagcgccgacaacctaagcgagaagctggaaagagaatgggatagggagctggccagcaagaagaaccccaagctcatcaacgccctgcggcgatgcttcttctggaggttcatgttctacggaatcttcctgtacctgggggaggtcaccaaggcagtacagcccctcctgctgggcagaatcatagccagctacgaccccgacaacaaggaggaacgcagcatcgcgatctacctgggcatcggcctgtgcctgctgttcatcgtgaggacactgctcctacaccccgccatcttcggcctgcaccacatcggaatgcagatgagaatcgccatgttcagcctgatctacaagaagaccctgaagctgagcagcagggtgctagacaagatcagcatcggacagctggtgagcctgctgagcaacaacctgaacaagttcgacgaaggactggcactggcacacttcgtgtggatcgccccactgcaagtggcactcctgatggggctgatctgggagctgctgcaggcgagcgccttctgcggactgggcttcctgatagtcctggccctgttccaggccgggctagggagaatgatgatgaagtacagagaccagagggccgggaagatcagcgagagactcgtgatcaccagcgagatgatcgagaacatccagagcgtgaaggcatactgctgggaagaggcaatggagaagatgatcgagaacctgagacagacagagctgaagctgacccggaaggcagcctacgtgagatacttcaacagcagcgccttcttcttcagcgggttcttcgtggtcttcctgagcgtgctgccctacgcactaatcaagggaatcatcctgcggaagatcttcacaaccatcagcttctgcatcgtgctgcgcatggcggtcacccggcagttcccctgggccgtacagacatggtacgacagcctgggagccatcaacaagatacaggacttcctgcagaagcaagagtacaagacactggagtacaacctgacgaccacagaagtagtgatggagaacgtaaccgccttctgggaggagggattcggggagctgttcgagaaagcaaagcagaacaacaacaaccggaagaccagcaacggcgacgacagcctcttcttcagcaacttcagcctgctgggcacccccgtcctgaaggacatcaacttcaagatagagaggggacagctgctggcggtggccggaagcaccggagcaggcaagaccagcctgctaatggtgatcatgggagaactggagcccagcgagggcaagatcaagcacagcggaaggatcagcttctgcagccagttcagctggatcatgcccggcaccatcaaggagaacatcatcttcggcgtgagctacgacgagtaccgctacagaagcgtcatcaaggcatgccaactagaagaggacatcagcaagttcgcagagaaggacaacatagtgctgggagaaggcggaatcacactgagcggaggccaacgagcaagaatcagcctggcaagagcagtatacaaggacgccgacctgtacctgctggacagccccttcggatacctagacgtgctgaccgagaaggagatattcgaaagctgcgtctgcaagctgatggccaacaagaccaggatcctggtcaccagcaagatggaacacctgaagaaagccgacaagatcctgatcctgcacgaaggcagcagctacttctacgggacattcagcgaactccagaacctacagccagacttcagcagcaagctcatgggatgcgacagcttcgaccagttcagcgcagagagacggaacagcatcctaaccgagacactgcacaggttcagcctggaaggagacgcccccgtcagctggacagagacgaagaaacagagcttcaaacagaccggagagttcggggagaaacgcaagaacagcatcctcaacccaatcaacagcatacgaaagttcagcatcgtgcagaagaccccactgcagatgaacggcatcgaagaggacagcgacgagcccctggagagaaggctgagcctggtaccagacagcgagcagggagaggcgatactgccccgcatcagcgtgatcagcaccggccccacgctgcaggcacgaaggcgccagagcgtcctgaacctgatgacacacagcgtgaaccaaggccagaacatccaccgaaagacaaccgcaagcacaaggaaggtgagcctggccccacaggcaaacctgaccgaactggacatctacagcagaaggctgagccaggagaccggcctggagatcagcgaagagatcaacgaagaggacctgaaggagtgcttcttcgacgacatggagagcataccagcagtgaccacatggaacacatacctgaggtacatcaccgtccacaagagcctgatcttcgtgctaatctggtgcctggtgatcttcctggcagaggtggccgccagcctggtggtgctgtggctcctgggaaacaccccactgcaagacaaagggaacagcacccacagcaggaacaacagctacgcagtgatcatcaccagcaccagcagctactacgtgttctacatctacgtgggagtagccgacaccctgctggccatgggattcttcagaggcctaccactggtgcacaccctaatcacagtgagcaagatcctgcaccacaagatgctgcacagcgtgctgcaagcacccatgagcaccctcaacacgctgaaggcaggcgggatcctgaacaggttcagcaaggacatagccatcctggacgacctgctgcccctgaccatcttcgacttcatccagctgctgctgatcgtgatcggagccatagcagtggtcgcagtgctgcaaccctacatcttcgtggcaacagtgccagtgatagtggccttcatcatgctgagagcatacttcctccaaaccagccagcaactcaagcagctggaaagcgaaggcaggagcccaatcttcacccacctggtgacaagcctgaagggactctggacactgagggccttcggacggcagccctacttcgaaaccctgttccacaaagccctgaacctgcacaccgccaactggttcctgtacctgagcacactgcgctggttccaaatgagaatagaaatgatcttcgtcatcttcttcatcgccgtgaccttcatcagcatcctgacaacaggagaaggagaaggaagagtgggcatcatcctgaccctggccatgaacatcatgagcacactgcagtgggccgtgaacagcagcatagacgtggacagcctgatgcgaagcgtgagccgagtcttcaagttcatcgacatgcccaccgagggcaagcccaccaagagcaccaagccctacaagaacggccaactcagcaaggtgatgatcatcgagaacagccacgtgaagaaagacgacatctggcccagcgggggccaaatgaccgtcaaagacctcacagccaagtacacagaaggcggaaacgccatcctggagaacatcagcttcagcatcagccccggccagagggtgggcctcctgggaagaaccggaagcggcaagagcaccctgctgagcgccttcctgagactactgaacaccgaaggcgagatccagatcgacggcgtgagctgggacagcatcaccctgcaacagtggaggaaggccttcggcgtgataccacagaaggtgttcatcttcagcggaaccttcaggaagaacctggacccctacgaacagtggagcgaccaggagatctggaaggtggcagacgaggtggggctcagaagcgtgatagaacagttccccgggaagctggacttcgtcctggtggacgggggctgcgtcctaagccacggccacaagcagctgatgtgcctggccagaagcgtgctcagcaaggcgaagatcctgctgctggacgaacccagcgcccacctggacccagtaacataccagatcatccggagaaccctgaagcaggcattcgccgactgcacagtaatcctctgcgaacacaggatagaagcaatgctggaatgccaacagttcctggtcatcgaagagaacaaggtgcggcagtacgacagcatccagaagctgctgaacgagaggagcctcttccggcaagccatcagccccagcgacagggtgaagctgttcccccaccggaacagcagcaagtgcaagagcaagccccagatcgccgccctgaaggaagagaccgaggaagaggtgcaggacaccaggctgtgaataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 60 - RNA, 4600 nt, synthetic construct
  misc_feature 1..4600: note = Synthetic construct
  source 1..4600: mol_type = other RNA
attattacatcaaaacaaaaagccgccaccatgcagaggagccccctggagaaggctagcgtggtgagcaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagagcttcaagcagaccggagagttcggcgagaagaggaagaacagcatcctgaacccaatcaacagcatcaggaagttcagcatcgtgcagaagaccccactgcagatgaacggcatcgaggaggacagcgacgagcccctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtagataagtgaactcgaggctggagcctcggtagccgttcctcctgcccgctgggcctcccaacgggccctcctcccctccttgcaccggcccttcctggtctttgaataaagtctgagtgggcatctag

SEQ ID NO: 61 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggagccccctggagaaggccagcgtggtgagcaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagccgcgtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagcgcgccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggcgagctggagcccagcgagggcaagatcaagcacagcggaagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggcggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcaccgcttcagcctggagggcgacgcccccgtgagctggaccgagaccaagaagcagagcttcaagcagaccggagagttcggcgagaagaggaagaacagcatcctgaaccccatcaacagcatcaggaagttcagcatcgtgcagaagaccccactgcagatgaacggcatcgaggaggacagcgacgagcccctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagcgcgtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccccagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggaccccgtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagcttttcccccaccggaacagcagcaagtgcaagagcaagccccagatcgccgccctgaaggaggagaccgaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 62 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagcgcagccccctggagaaggccagcgtggtgagcaagctgttcttcagctggacccgccccatcctgcgcaagggctacagacagcgcctggagctgagcgacatctaccagatcccttctgtggacagcgccgacaacctgagcgagaagctggagcgcgagtgggaccgcgagctggccagcaagaagaaccctaagctgatcaacgccctgcgccgctgcttcttctggcgcttcatgttctacggcatcttcctgtacctgggggaggtgaccaaggccgtgcagcccctgctgctgggccgcatcatcgccagctacgaccccgacaacaaggaggagcgcagcatcgccatctacctgggcatcggcctgtgcctgctgttcatcgtgcgcaccctgctgctgcaccccgccatcttcggcctgcaccacatcggcatgcagatgcgcatcgccatgttcagcctgatctacaagaagaccctgaagctgtcaagcagggtgctggacaagatcagcatcggccagctggtgagcctgctgagcaacaacctgaacaagttcgacgagggcctggccctggcccacttcgtgtggatcgctcccctgcaggtggccctgctgatgggcctgatctgggagctgctgcaggccagcgccttctgcggcctgggcttcctgatcgtgctggccctgttccaggccggcctgggccgcatgatgatgaagtacagagaccagcgcgccggcaagatcagcgagcgcctggtgatcaccagcgagatgatcgagaacatccagagcgtgaaggcctactgctgggaggaggccatggagaagatgatcgagaacctgcgccagaccgagctgaagctgacccgcaaggccgcctacgtgcgctacttcaacagcagcgccttcttcttctcaggcttcttcgtggtgttcctgagcgtgctgccctacgccctgatcaagggcatcatcctgcgcaagatcttcaccaccatcagcttctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggcttcggcgagctgttcgagaaggccaagcagaacaacaacaaccgcaagaccagcaacggcgacgacagcctgttcttcagcaacttcagcctgctgggcacccccgtgctgaaggacatcaacttcaagatcgagcgcggccagctgctggccgtggccggcagcaccggcgccggcaagacctcactgctgatggtgatcatgggcgagctggagcctagcgagggcaagatcaagcacagcggccgcatctcattctgcagccagttcagctggatcatgcccggcaccatcaaggagaacatcatcttcggtgtgagctacgacgagtaccgctaccgcagcgtgatcaaggcctgccagctggaggaggacatcagcaagttcgccgagaaggacaacatcgtgctgggagagggtggcatcaccctgagcggcggccagagggcccgcatcagcctggcccgcgccgtgtacaaggacgccgacctgtacctgctggacagccccttcggatacctggacgtgctgaccgagaaggagatcttcgagagctgcgtgtgcaagctgatggccaacaagacccgcatcctggtgacctctaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagcgccgcaacagcatcctgaccgagaccctgcaccgcttcagcctggagggcgacgcccccgtgagctggaccgagaccaagaagcagtctttcaagcagaccggcgagttcggcgagaagcgcaagaacagcatcctgaaccccatcaacagcatccgcaagttcagcatcgtgcagaagaccccactgcagatgaacggcatcgaggaggacagcgacgagcccctggagcgccgcctgagcctggtgcccgacagcgagcagggcgaggccatcctgcctcgcatcagcgtgatcagcaccggccccaccctgcaggcccgccgccgccagagcgtgctgaacctgatgacccacagcgtgaaccagggccagaacatccacaggaagaccaccgccagcaccaggaaagtgagcctggcccctcaggccaacctgaccgagctggacatctacagccgcaggctgagccaggagaccggcctggagatcagcgaggagatcaacgaggaggacctgaaggagtgcttcttcgacgacatggagagcatccccgccgtgaccacctggaacacctacctgcgctacatcaccgtgcacaagagcctgatcttcgtgctgatctggtgcctggtgatcttcctggccgaggtggccgccagcctggtggtgctgtggctgctgggcaacacccctctgcaggacaagggcaacagcacccacagccgcaacaacagctacgccgtgatcatcaccagcaccagcagctactacgtgttctacatctacgtgggagtggccgacaccctgctggccatgggcttcttccgcggcctgcccctggtgcacaccctgatcaccgtgagcaagatcctgcaccacaagatgctgcacagcgtgctgcaggcccccatgagcaccctgaacaccctgaaggccggtggcatcctgaaccgcttcagcaaggacatcgccatcctggacgacctgctgcccctgaccatcttcgacttcatccagctgctgctgatcgtgatcggcgccatcgccgtggtggccgtgctgcagccctacatcttcgtggccaccgtgcccgtgatcgtggccttcatcatgctgcgcgcctacttcctgcagaccagccagcagctgaagcagctggagagcgagggccgcagccccatcttcacccacctggtgaccagcctgaagggcctgtggaccctgcgcgccttcggccggcagccctacttcgagaccctgttccacaaggccctgaacctgcacaccgccaactggttcctgtacctgagcaccctgcgctggttccagatgcgcatcgagatgatcttcgtgatcttcttcatcgccgtgaccttcatcagcatcctgaccaccggcgagggcgagggacgcgtgggcatcatcctgaccctggccatgaacatcatgagcaccctgcagtgggccgtgaacagcagcatcgacgtggacagcctgatgaggagcgtgagcagggtgttcaagttcatcgacatgcccaccgagggcaagcctaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttctcaatcagccccggccagcgcgtgggcctgctgggccgcaccggctcaggcaagagcaccctgctgagcgccttcctgcgcctgctgaacaccgagggcgagatccagatcgacggcgtgagctgggacagcatcaccctgcagcagtggcgcaaggccttcggcgtgatcccccagaaggtgttcatcttctctggcaccttccgcaagaacctggacccctacgagcagtggagcgaccaggagatctggaaggtggccgacgaggtgggcctgcgcagcgtgatcgagcagttccccggcaagctggacttcgtgctggtggacgggggctgcgtgctgagccacggccacaagcagctgatgtgcctggcccgcagcgtgctgagcaaggccaagatcctgctgctggacgagcccagcgcccacctggaccccgtgacctaccagatcatccgccgcaccctgaagcaggccttcgccgactgcaccgtgatcctgtgcgagcaccgcatcgaggccatgctggagtgccagcagttcctggtgatcgaggagaacaaggtgcgccagtacgactccatccagaagctgctgaacgagcgcagcctgttccgccaggccatcagccccagcgaccgcgtgaagcttttcccccaccgcaacagcagcaagtgcaagtctaagccccagatcgccgccctgaaggaggagaccgaggaggaggtgcaggacacccgcctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 63 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggtcgcctctggagaaggccagcgtggtgtccaagctgttcttcagctggaccagacccatcctgaggaagggctaccgccagcgcctggagctgagcgacatctaccagatccccagcgtggacagcgctgacaacctgagcgagaagctggagagagagtgggaccgcgagctggccagcaagaagaaccctaagctgatcaacgccctgcggcgctgcttcttctggcgcttcatgttctacggcatcttcctgtacctgggcgaggtgaccaaggccgtgcagcccctgctgctgggccgcatcatcgccagctacgaccccgacaacaaggaggagcgctctatcgccatctacctgggcatcggcctgtgcctgctgttcatcgtgcgcaccctgctgctgcaccccgccatcttcggcctgcaccacatcggcatgcagatgcgcatcgccatgttcagcctgatctacaagaagaccctgaagctgagcagccgcgtgctggacaagatcagtatcggccagctggtgagcctgctgtccaacaacctgaacaagttcgacgagggcctggccctggcccacttcgtgtggatcgcccctctgcaggtggccctgctgatggggctgatctgggagctgctgcaggccagcgccttctgcggcctgggcttcctgatcgtgctggccctgttccaggccggcctgggcagaatgatgatgaagtaccgcgaccagcgcgccggcaagatcagcgagagactggtgatcaccagcgagatgatcgagaacatccagtctgtgaaggcctactgctgggaggaggccatggagaagatgatcgagaacctgcgccagaccgagctgaagctgacccggaaggccgcctacgtgcgctacttcaacagcagcgccttcttcttctcaggcttcttcgtggtgttcctgagcgtgctgccctacgccctgatcaagggcatcatcctgcggaagatcttcaccaccatcagcttctgcatcgtgctgcgcatggccgtgacccgccagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagggcttcggcgagctgttcgagaaggccaagcagaacaacaacaacagaaagaccagcaacggcgacgacagcctgttcttcagcaacttcagcctgctgggcacccccgtgctgaaggacatcaacttcaagatcgagcgcggccagctgctggccgtggccggcagcaccggcgccggcaagaccagcctgctgatggtgatcatgggcgagctggagcccagcgagggcaagatcaagcacagcggacgcatcagcttctgcagccagttctcctggatcatgcctggcaccatcaaggagaacatcatcttcggcgtgagctacgacgagtaccgctaccgcagcgtgatcaaggcctgccagctggaggaggacatcagcaagttcgccgagaaggacaacatcgtgctgggagagggcggcatcaccctgagcggcggccagagggcccgcatcagcctggcaagagcagtgtacaaggacgccgacctgtacctgctggacagccccttcggctacctggacgtgctgaccgagaaggagatcttcgagagctgcgtgtgcaagctgatggccaacaagacccgcatcctggtgaccagcaagatggagcacctgaagaaggctgacaagatcctgatcctgcacgagggcagcagctacttctacggcaccttcagcgagctgcagaacctgcagccagacttcagcagcaagctgatgggctgcgacagcttcgaccagttcagcgccgagagaagaaacagcatcctgaccgagaccctgcaccgcttcagcctggagggcgacgcccccgtgtcctggaccgagaccaagaagcagagcttcaagcagaccggcgagttcggcgagaagcgcaagaactctatcctgaaccccatcaacagcatccgcaagttcagcatcgtgcagaagaccccactgcagatgaacggcatcgaggaggacagcgacgagcccctggagcgccgcctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcacccgcaaagtgagcctggccccacaggccaacctgaccgagctggacatctacagccgccgcctgtctcaggagaccggcctggagatcagcgaggagatcaacgaggaggacctgaaggagtgcttcttcgacgacatggagagcatccccgccgtgaccacctggaacacctacctgcgctacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagccgcaacaacagctacgccgtgatcatcaccagcaccagcagctactacgtgttctacatctacgtgggcgtggccgacaccctgctggccatgggcttcttcagaggcctgcccctggtgcacaccctgatcaccgtgagcaagatcctgcaccacaagatgctgcacagcgtgctgcaggcccccatgagcaccctgaacaccctgaaggccggcggcatcctgaaccgcttcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagtctgagggcaggagccccatcttcacccacctggtgaccagcctgaagggcctgtggaccctgagggccttcggccggcagccttacttcgagaccctgttccacaaggccctgaacctgcacaccgccaactggttcctgtacctgagcaccctgcgctggttccagatgcgcatcgagatgatcttcgtgatcttcttcatcgccgtgaccttcatcagcatcctgaccaccggcgagggagagggcagagtgggcatcatcctgaccctggccatgaacatcatgagcaccctgcagtgggctgtgaacagcagcatcgacgtggacagcctgatgcgcagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttctcaatcagccccggccagcgcgtgggcctgctgggacgcaccggcagcggcaagagcaccctgctgagcgccttcctgagactgctgaacaccgagggcgagatccagatcgacggcgtgagctgggactcaatcaccctgcagcagtggaggaaggccttcggcgtgatcccccagaaggtgttcatcttcagcggcaccttccgcaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggcccgctctgtgctgagcaaggccaagatcctgctgctggacgagcccagtgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcgccagtacgacagcatccagaagctgctgaacgagaggagcctgttccgccaggccatcagccccagcgacagggtgaagcttttcccccaccgcaacagcagcaagtgcaagagcaagccccagatcgccgccctgaaggaggagaccgaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 64 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagcgcagccccctggagaaggccagcgtggtgtccaagctgttcttcagctggacccgccccatcctgaggaagggctaccgccagcgcctggagctgagcgacatctaccagatccctagcgtggacagcgccgacaacctgagcgagaagctggagcgcgagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggccgcatcatcgcctcctacgaccccgacaacaaggaggagcgcagcatcgccatctacctgggcatcggcctgtgcctgctgttcatcgtgcgcaccctgctgctgcaccccgccatcttcggcctgcaccacatcggcatgcagatgcgcatcgccatgttcagcctgatctacaagaagaccctgaagctgagcagccgcgtgctggacaagatcagcatcggccagctggtgagcctgctgtccaacaacctgaacaagttcgacgagggactggccctggcccacttcgtgtggatcgcccctctgcaggtggccctgctgatggggctgatctgggagctgctgcaggccagcgccttctgcggcctgggcttcctgatcgtgctggccctgttccaggccggcctgggcagaatgatgatgaagtaccgcgaccagcgcgccggcaagatcagcgagcgcctggtgatcaccagcgagatgatcgagaacatccagagcgtgaaggcctactgctgggaggaggccatggagaagatgatcgagaacctgagacagaccgagctgaagctgacccgcaaggccgcctacgtgagatacttcaacagcagcgccttcttcttcagcggcttcttcgtggtgttcctgtctgtgctgccctacgccctgatcaagggcatcatcctgcgcaagatcttcaccaccatctcattctgcatcgtgctgcgcatggccgtgacccggcagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaaccgcaagaccagcaacggcgacgacagcctgttcttcagcaacttcagcctgctgggcacccctgtgctgaaggacatcaacttcaagatcgagcgcggccagctgctggccgtggccggcagcaccggcgccggcaagaccagcctgctgatggtgatcatgggagagctggagcctagcgagggcaagatcaagcacagtggacgcatcagcttctgcagccagttctcctggatcatgcctggcaccatcaaggagaacatcatcttcggcgtgtcctacgacgagtaccgctacagaagcgtgatcaaggcctgccagctggaggaggacatcagcaagttcgccgagaaggacaacatcgtgctgggagagggcggcatcaccctgagcggaggccagcgcgccagaatcagcctggccagagccgtgtacaaggacgccgacctgtacctgctggacagccccttcggctacctggacgtgctgaccgagaaggagatcttcgagagctgcgtgtgcaagctgatggccaacaagaccaggatcctggtgacctctaagatggagcacctgaagaaggccgacaagatcctgatcctgcacgagggcagcagctacttctacggcaccttcagcgagctgcagaacctgcagccagacttcagcagcaagctgatgggctgcgacagcttcgaccagttcagcgccgagcgccgcaacagcatcctgaccgagaccctgcaccgcttcagcctggagggcgacgcccccgtgagctggaccgagaccaagaagcagagcttcaagcagaccggagagttcggcgagaagaggaagaacagcatcctgaaccccatcaacagcatcaggaagttctccatcgtgcagaagaccccactgcagatgaacggcatcgaggaggacagcgacgagcccctggagcgccgcctgagcctggtgccagacagcgagcagggcgaggccatcctgccccgcatcagcgtgatcagcaccggccccaccctgcaggcccgcaggaggcagagcgtgctgaacctgatgacccacagcgtgaaccagggccagaacatccacaggaagaccaccgcctccacccgcaaagtgagcctggccccacaggccaacctgaccgagctggacatctacagccgccgcctgagccaggagaccggcctggagatcagcgaggagatcaacgaggaggacctgaaggagtgcttcttcgacgacatggagagcatcccagccgtgaccacctggaacacctacctgcgctacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagccgcaacaacagctacgccgtgatcatcaccagcaccagcagctactacgtgttctacatctacgtgggcgtggccgacaccctgctggccatgggcttcttccgcggcctgcccctggtgcacaccctgatcaccgtgagcaagatcctgcaccacaagatgctgcacagcgtgctgcaggcccccatgagcaccctgaacaccctgaaggccggtggcatcctgaaccgcttcagcaaggacatcgccatcctggacgacctgctgcccctgaccatcttcgacttcatccagctgctgctgatcgtgatcggcgccatcgccgtggtggccgtgctgcagccctacatcttcgtggccaccgtgcccgtgatcgtggccttcatcatgctgagagcctacttcctgcagaccagccagcagctgaagcagctggagagcgagggccgcagtccaatcttcacccacctggtgaccagcctgaagggcctgtggaccctgcgcgccttcggccgccagccctacttcgagaccctgttccacaaggctctgaacctgcacaccgccaactggttcctgtacctgagcaccctgcgctggttccagatgcgcatcgagatgatcttcgtgatcttcttcatcgccgtgaccttcatcagcatcctgaccaccggcgagggagagggcagagtgggcatcatcctgaccctggccatgaacatcatgagcaccctgcagtgggccgtgaactccagcatcgacgtggacagcctgatgaggtctgtgagccgcgtgttcaagttcatcgacatgccaaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttctcaatcagccccggccagcgcgtgggcctgctgggacgcaccggcagcggcaagagcaccctgctgagcgccttcctgagactgctgaacaccgagggcgagatccagatcgacggcgtgtcttgggactcaatcaccctgcagcagtggcgcaaggccttcggcgtgatcccccagaaggtgttcatcttcagcggaaccttcagaaagaacctggacccctacgagcagtggagcgaccaggagatctggaaggtggccgacgaggtgggcctgcgcagcgtgatcgagcagttccccggcaagctggacttcgtgctggtggacggcggctgcgtgctgagccacggccacaagcagctgatgtgcctggccagaagcgtgctgagcaaggccaagatcctgctgctggacgagcccagcgcccacctggaccccgtgacctaccagatcatccgcagaaccctgaagcaggccttcgccgactgcaccgtgatcctgtgcgagcaccgcatcgaggccatgctggagtgccagcagttcctggtgatcgaggagaacaaggtgcgccagtacgacagcatccagaagctgctgaacgagcgcagcctgttccgccaggccatcagccccagcgaccgcgtgaagcttttcccccaccgcaacagcagcaagtgcaagtctaagccccagatcgccgccctgaaggaggagaccgaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 65 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagcgcagccccctggagaaggccagcgtggtgagcaagctgttcttcagctggacccgcccaatcctgcgcaagggctaccgccagcgcctggagctgagcgacatctaccagatccccagcgtggacagcgccgacaacctgagcgagaagctggagagagagtgggaccgcgagctggccagcaagaagaaccctaagctgatcaacgccctgcggcgctgcttcttctggcgcttcatgttctacggcatcttcctgtacctgggcgaggtgaccaaggccgtgcagcccctgctgctgggccgcatcatcgcctcctacgaccccgacaacaaggaggagcgcagcatcgccatctacctgggcatcggcctgtgcctgctgttcatcgtgcgcaccctgctgctgcaccccgccatcttcggcctgcaccacatcggcatgcagatgcgcatcgccatgttcagcctgatctacaagaagaccctgaagctgagcagccgcgtgctggacaagatcagcatcggccagctggtgagcctgctgtccaacaacctgaacaagttcgacgagggcctggccctggcccacttcgtgtggatcgccccactgcaggtggccctgctgatggggctgatctgggagctgctgcaggcctctgccttctgcggcctgggcttcctgatcgtgctggccctgttccaggccggcctgggcagaatgatgatgaagtacagagaccagcgcgccggcaagatcagcgagcgcctggtgatcacctcagagatgatcgagaacatccagtctgtgaaggcctactgctgggaggaggccatggagaagatgatcgagaacctgcgccagaccgagctgaagctgacccgcaaggccgcctacgtgcgctacttcaacagcagcgccttcttcttctcaggcttcttcgtggtgttcctgagcgtgctgccctacgccctgatcaagggcatcatcctgcgcaagatcttcaccaccatcagcttctgcatcgtgctgcgcatggccgtgacccgccagttcccctgggccgtgcagacctggtacgactctctgggcgccatcaacaagatccaggacttcctgcagaagcaggagtacaagaccctggagtacaacctgaccaccaccgaggtggtgatggagaacgtgaccgccttctgggaggagggcttcggcgagctgttcgagaaggccaagcagaacaacaacaaccgcaagaccagcaacggcgacgacagcctgttcttcagcaacttcagcctgctgggcacccccgtgctgaaggacatcaacttcaagatcgagcgcggccagctgctggccgtggccggcagcaccggcgccggcaagaccagcctgctgatggtgatcatgggcgagctggagcctagcgagggcaagatcaagcacagcggcagaatctcattctgctctcagttcagctggatcatgcctggcaccatcaaggagaacatcatcttcggcgtgtcctacgacgagtaccgctaccgcagcgtgatcaaggcctgccagctggaggaggacatcagcaagttcgccgagaaggacaacatcgtgctgggagagggcggcatcaccctgagcggcggccagcgcgcccgcatcagcctggcccgcgccgtgtacaaggacgccgacctgtacctgctggactctcctttcggctacctggacgtgctgaccgagaaggagatcttcgagagctgcgtgtgcaagctgatggccaacaagacccgcatcctggtgaccagcaagatggagcacctgaagaaggccgacaagatcctgatcctgcacgagggcagcagctacttctacggcaccttcagcgagctgcagaacctgcagccagacttcagcagcaagctgatgggctgcgacagcttcgaccagttcagcgccgagcgccgcaacagcatcctgaccgagaccctgcaccgcttcagcctggagggcgacgcccccgtgagctggaccgagaccaagaagcagtctttcaagcagaccggcgagttcggcgagaagaggaagaacagcatcctgaacccaatcaacagcatccgcaagttcagcatcgtgcagaagaccccactgcagatgaacggcatcgaggaggacagcgacgagcctctggagcgccgcctgtccctggtgcccgacagcgagcagggcgaggccatcctgccccgcatcagcgtgatcagcaccggccccaccctgcaggcccgccgccgccagagcgtgctgaacctgatgacccacagcgtgaaccagggccagaacatccaccgcaagaccaccgccagcacccgcaaagtgagcctggccccacaggccaacctgaccgagctggacatctacagcagacgcctgagccaggagaccggcctggagatcagcgaggagatcaacgaggaggacctgaaggagtgcttcttcgacgacatggagagcatcccagccgtgaccacctggaacacctacctgcgctacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagccgcaacaacagctacgccgtgatcatcaccagcaccagcagctactacgtgttctacatctacgtgggcgtggccgacaccctgctggccatgggcttcttccgcggcctgcccctggtgcacaccctgatcaccgtgagcaagatcctgcaccacaagatgctgcacagcgtgctgcaggcccccatgagcaccctgaacaccctgaaggccggtggcatcctgaaccgcttcagcaaggacatcgccatcctggacgacctgctgcccctgaccatcttcgacttcatccagctgctgctgatcgtgatcggcgccatcgccgtggtggccgtgctgcagccctacatcttcgtggccaccgtgccagtgatcgtggccttcatcatgctgcgcgcctacttcctgcagaccagccagcagctgaagcagctggagagcgagggccgcagccccatcttcacccacctggtgaccagcctgaagggcctgtggaccctgcgcgccttcggccgccagccttacttcgagaccctgttccacaaggctctgaacctgcacaccgccaactggttcctgtacctgagcaccctgcgctggttccagatgcgcatcgagatgatcttcgtgatcttcttcatcgccgtgaccttcatcagcatcctgaccaccggcgagggcgagggccgcgtgggcatcatcctgaccctggccatgaacatcatgagcaccctgcagtgggccgtgaacagcagcatcgacgtggacagcctgatgcgcagcgtgagccgcgtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatctccttcagcatcagccccggccagcgcgtgggcctgctgggccgcaccggcagcggcaagagcaccctgctgagcgccttcctgcgcctgctgaacaccgagggcgagatccagatcgacggcgtgtcttgggacagcatcaccctgcagcagtggcgcaaggccttcggcgtgatcccccagaaggtgttcatcttcagcggcaccttccgcaagaacctggacccctacgagcagtggagcgaccaggagatctggaaggtggccgacgaggtgggcctgcgcagcgtgatcgagcagttccccggcaagctggacttcgtgctggtggacggcggctgcgtgctgagccacggccacaagcagctgatgtgcctggcccgcagcgtgctgagcaaggccaagatcctgctgctggacgagcccagcgcccacctggaccccgtgacctaccagatcatccgccgcaccctgaagcaggccttcgccgactgcaccgtgatcctgtgcgagcaccgcatcgaggccatgctggagtgccagcagttcctggtgatcgaggagaacaaggtgcggcagtacgacagcatccagaagctgctgaacgagaggagcctgttccgccaggccatcagccccagcgaccgcgtgaagcttttcccccaccgcaacagcagcaagtgcaagagcaagccccagatcgccgccctgaaggaggagaccgaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 66 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggtcgcccctggagaaggctagcgtggtgagcaagctgttcttcagctggaccagaccaatcctgaggaagggctacagacagcgcctggagctgtcagacatctaccagatccctagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagtatcggacagctggtgagcctgctgagcaacaacctgaacaagttcgacgagggactggccctggcccacttcgtgtggatcgcccctctgcaggtggccctgctgatggggctgatctgggagctgctgcaggccagcgccttctgcggcctgggcttcctgatcgtgctggccctgttccaggccggcctgggcagaatgatgatgaagtacagagaccagagagctggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttctcctggatcatgcccggcaccatcaaggagaacatcatcttcggtgtgagctacgacgagtacagatacagaagcgtgatcaaggcctgccagctggaggaggacatctccaagttcgcagagaaggacaacatcgtgctgggagagggtggcatcaccctgagcggaggccagagggccagaatctctctggcaagagcagtgtacaaggacgccgacctgtacctgctggactctcccttcggatacctggacgtgctgaccgagaaggagatcttcgagagctgcgtgtgcaagctgatggccaacaagaccaggatcctggtgacctctaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagagcttcaagcagaccggagagttcggcgagaagaggaagaacagcatcctgaacccaatcaacagcatcaggaagttctccatcgtgcagaagaccccactgcagatgaacggcatcgaggaggacagcgacgagcccctggagagaaggctgagcctggtgccagactctgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggtgggatcctgaacagattctccaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagtctgagggcaggagtccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggactcaatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagatctgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 67 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggagccccctggagaaggctagcgtggtgagcaagctgttcttcagctggaccagaccaatcctgaggaagggctacagacagcgcctggagctgtcagacatctaccagatccccagcgtggactctgccgacaacctgtctgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagctggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccctgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttcagctggatcatgcccggcaccatcaaggagaacatcatcttcggtgtgtcctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgctgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgtcctggaccgagaccaagaagcagtctttcaagcagaccggagagttcggcgagaagaggaagaacagcatcctgaacccaatcaactctatcaggaagttcagcatcgtgcagaagaccccactgcagatgaacggcatcgaggaggacagcgacgagcccctggagagaaggctgagcctggtgccagacagcgagcagggcgaggccatcctgcctcgcatcagcgtgatcagcaccggccccaccctgcaggccaggaggaggcagtctgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggtgggatcctgaacagattctccaaggacatcgccatcctggacgacctgctgcctctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaactccagcatcgacgtggacagcctgatgaggagcgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccctggcaagctggacttcgtgctggtggacgggggctgcgtgctgagccacggccacaagcagctgatgtgcctggccagatctgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 68 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggtcgcccctggagaaggctagcgtggtgtccaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcctctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagcatcggacagctggtgagtctgctgagcaacaacctgaacaagttcgacgagggactggccctggcccacttcgtgtggatcgctccactgcaggtggccctgctgatggggctgatctgggagctgctgcaggccagcgccttctgcggcctgggcttcctgatcgtgctggccctgttccaggccggcctgggcagaatgatgatgaagtacagagaccagagagctggcaagatcagcgagagactggtgatcacctcagagatgatcgagaacatccagtctgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccccgtgctgaaggacatcaacttcaagatcgagagaggacagctgctggccgtggccggatccaccggagccggcaagaccagcctgctgatggtgatcatgggagagctggagccctcagagggcaagatcaagcacagtggaagaatctcattctgcagccagttctcctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagtctttcaagcagaccggagagttcggcgagaagaggaagaacagcatcctgaacccaatcaacagcatcaggaagttcagcatcgtgcagaagaccccactgcagatgaacggcatcgaggaggacagcgacgagcctctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggcccctcaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccctatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagtccaatcttcacccacctggtgaccagcctgaagggactgtggaccctgagggccttcggccggcagccttacttcgagaccctgttccacaaggccctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggctcaggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagcccctccgacagggtgaagctgttcccccaccggaacagcagcaagtgcaagagcaagccccagatcgccgccctgaaggaggagaccgaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 69 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggtcgcccctggagaaggctagcgtggtgagcaagctgttcttcagctggaccagaccaatcctgaggaagggctacagacagcgcctggagctgagcgacatctaccagatccctagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcctctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagtatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcacctcagagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccctgtgctgaaggacatcaacttcaagatcgagagaggacagctgctggccgtggccggaagcaccggagccggcaagaccagcctgctgatggtgatcatgggagagctggagccctcagagggcaagatcaagcacagcggaagaatcagcttctgcagccagttcagctggatcatgcccggcaccatcaaggagaacatcatcttcggtgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatctctctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgtcctggaccgagaccaagaagcagagcttcaagcagaccggagagttcggcgagaagaggaagaacagcatcctgaacccaatcaactctatcaggaagttcagcatcgtgcagaagaccccactgcagatgaacggcatcgaggaggacagcgacgagcccctggagagaaggctgtccctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgcctctctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccctatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggctctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggctgtgaacagcagcatcgacgtggacagcctgatgaggagcgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttctcaatcagccctggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccctggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagtctaagccccagatcgccgccctgaaggaggagaccgaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 70 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggagccccctggagaaggccagcgtggtgagcaagctgttcttcagctggaccagaccaatcctgcgcaagggctaccgccagcgcctggagctgagcgacatctaccagatccccagcgtggacagcgccgacaacctgagcgagaagctggagagagagtgggacagagagctggccagcaagaagaaccccaagctgatcaacgccctgcgcaggtgcttcttctggagattcatgttctacggaatcttcctgtacctgggcgaggtgaccaaggccgtgcagcccctgctgctgggaagaatcatcgccagctacgaccccgacaacaaggaggagcgcagcatcgccatctacctgggcatcggcctgtgcctgctgttcatcgtgcgcaccctgctgctgcacccagccatcttcggcctgcaccacatcggaatgcagatgcgcatcgccatgttcagcctgatctacaagaagaccctgaagctgagcagccgcgtgctggacaagatcagcatcggacagctggtgagcctgctgagcaacaacctgaacaagttcgacgagggactggccctggcccacttcgtgtggatcgccccactgcaggtggccctgctgatgggcctgatctgggagctgctgcaggccagcgccttctgcggcctgggcttcctgatcgtgctggccctgttccaggccggcctgggcagaatgatgatgaagtacagagaccagcgcgccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgcgctacttcaacagcagcgccttcttcttcagcgggttcttcgtggtgttcctgagcgtgctgccctacgccctgatcaagggcatcatcctgcgcaagatcttcaccaccatcagcttctgcatcgtgctgcgcatggccgtgacccgccagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaaccgcaagaccagcaacggcgacgacagcctgttcttcagcaacttcagcctgctgggcacccccgtgctgaaggacatcaacttcaagatcgagcgcggacagctgctggccgtggccggaagcaccggagccggcaagaccagcctgctgatggtgatcatgggcgagctggagcccagcgagggcaagatcaagcacagcggacgcatcagcttctgcagccagttcagctggatcatgcccggcaccatcaaggagaacatcatcttcggcgtgagctacgacgagtacagataccgcagcgtgatcaaggcctgccagctggaggaggacatcagcaagttcgcagagaaggacaacatcgtgctgggcgagggcggcatcaccctgagcggcggccagagggccagaatcagcctggcacgcgcagtgtacaaggacgccgacctgtacctgctggacagccccttcggctacctggacgtgctgaccgagaaggagatcttcgagagctgcgtgtgcaagctgatggccaacaagacccgcatcctggtgaccagcaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagagaagaaacagcatcctgaccgagaccctgcaccgcttcagcctggagggcgacgcccccgtgagctggaccgagaccaagaagcagagcttcaagcagaccggcgagttcggcgagaagcgcaagaacagcatcctgaaccccatcaacagcatcaggaagttcagcatcgtgcagaagaccccactgcagatgaacggcatcgaggaggacagcgacgagcccctggagcgcaggctgagcctggtgccagacagcgagcagggcgaggccatcctgccccgcatcagcgtgatcagcaccggccccaccctgcaggccaggcgccgccagagcgtgctgaacctgatgacccacagcgtgaaccagggccagaacatccacaggaagaccaccgccagcaccaggaaggtgagcctggccccacaggccaacctgaccgagctggacatctacagcagacgcctgagccaggagaccggcctggagatcagcgaggagatcaacgaggaggacctgaaggagtgcttcttcgacgacatggagagcatcccagccgtgaccacctggaacacctacctgcgctacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggcgccatcgccgtggtggccgtgctgcagccctacatcttcgtggccaccgtgccagtgatcgtggccttcatcatgctgagagcctacttcctgcagaccagccagcagctgaagcagctggagagcgagggccgcagccccatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggcgagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagcgcgtgggcctgctgggacgcaccggcagcggcaagagcaccctgctgagcgccttcctgagactgctgaacaccgagggcgagatccagatcgacggcgtgagctgggacagcatcaccctgcagcagtggaggaaggccttcggcgtgatcccccagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggaccccgtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgaccgcgtgaagcttttcccccaccgcaacagcagcaagtgcaagagcaagccccagatcgccgccctgaaggaggagaccgaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 71 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagcgcagccccctggagaaggccagcgtggtgagcaagctgttcttcagctggacccgccccatcctgcgcaagggctaccgccagcgcctggagctgagcgacatctaccagatccccagcgtggacagcgccgacaacctgagcgagaagctggagcgcgagtgggacagagagctggccagcaagaagaaccccaagctgatcaacgccctgcgcaggtgcttcttctggcgcttcatgttctacggaatcttcctgtacctgggcgaggtgaccaaggccgtgcagcccctgctgctgggccgcatcatcgccagctacgaccccgacaacaaggaggagcgcagcatcgccatctacctgggcatcggcctgtgcctgctgttcatcgtgcgcaccctgctgctgcaccccgccatcttcggcctgcaccacatcggaatgcagatgcgcatcgccatgttcagcctgatctacaagaagaccctgaagctgagcagccgcgtgctggacaagatcagcatcggccagctggtgagcctgctgagcaacaacctgaacaagttcgacgagggactggccctggcccacttcgtgtggatcgccccactgcaggtggccctgctgatgggcctgatctgggagctgctgcaggccagcgccttctgcggcctgggcttcctgatcgtgctggccctgttccaggccggcctgggccgcatgatgatgaagtaccgcgaccagcgcgccggcaagatcagcgagagactggtgatcaccagcgagatgatcgagaacatccagagcgtgaaggcctactgctgggaggaggccatggagaagatgatcgagaacctgagacagaccgagctgaagctgacccggaaggccgcctacgtgcgctacttcaacagcagcgccttcttcttcagcggcttcttcgtggtgttcctgagcgtgctgccctacgccctgatcaagggcatcatcctgcgcaagatcttcaccaccatcagcttctgcatcgtgctgcgcatggccgtgacccgccagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaaccgcaagaccagcaacggcgacgacagcctgttcttcagcaacttcagcctgctgggcacccccgtgctgaaggacatcaacttcaagatcgagcgcggccagctgctggccgtggccggaagcaccggagccggcaagaccagcctgctgatggtgatcatgggcgagctggagcccagcgagggcaagatcaagcacagcggccgcatcagcttctgcagccagttcagctggatcatgcccggcaccatcaaggagaacatcatcttcggcgtgagctacgacgagtaccgctaccgcagcgtgatcaaggcctgccagctggaggaggacatcagcaagttcgccgagaaggacaacatcgtgctgggcgagggcggcatcaccctgagcggcggccagcgcgcccgcatcagcctggcccgcgccgtgtacaaggacgccgacctgtacctgctggacagccccttcggctacctggacgtgctgaccgagaaggagatcttcgagagctgcgtgtgcaagctgatggccaacaagacccgcatcctggtgaccagcaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagagaagaaacagcatcctgaccgagaccctgcaccgcttcagcctggagggcgacgcccccgtgagctggaccgagaccaagaagcagagcttcaagcagaccggcgagttcggcgagaagcgcaagaacagcatcctgaaccccatcaacagcatccgcaagttcagcatcgtgcagaagaccccactgcagatgaacggcatcgaggaggacagcgacgagcccctggagcgccgcctgagcctggtgcccgacagcgagcagggcgaggccatcctgccccgcatcagcgtgatcagcaccggccccaccctgcaggcccgccgccgccagagcgtgctgaacctgatgacccacagcgtgaaccagggccagaacatccaccgcaagaccaccgccagcacccgcaaagtgagcctggccccacaggccaacctgaccgagctggacatctacagcagacgcctgagccaggagaccggcctggagatcagcgaggagatcaacgaggaggacctgaaggagtgcttcttcgacgacatggagagcatcccagccgtgaccacctggaacacctacctgcgctacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggcgtggccgacaccctgctggccatgggcttcttccgcggcctgccactggtgcacaccctgatcaccgtgagcaagatcctgcaccacaagatgctgcacagcgtgctgcaggcccccatgagcaccctgaacaccctgaaggccggcgggatcctgaaccgcttcagcaaggacatcgccatcctggacgacctgctgcccctgaccatcttcgacttcatccagctgctgctgatcgtgatcggcgccatcgccgtggtggccgtgctgcagccctacatcttcgtggccaccgtgcccgtgatcgtggccttcatcatgctgagagcctacttcctgcagaccagccagcagctgaagcagctggagagcgagggccgcagccccatcttcacccacctggtgaccagcctgaagggcctgtggaccctgagggccttcggccgccagccctacttcgagaccctgttccacaaggccctgaacctgcacaccgccaactggttcctgtacctgagcaccctgcgctggttccagatgcgcatcgagatgatcttcgtgatcttcttcatcgccgtgaccttcatcagcatcctgaccaccggcgagggcgagggacgcgtgggcatcatcctgaccctggccatgaacatcatgagcaccctgcagtgggccgtgaacagcagcatcgacgtggacagcctgatgaggagcgtgagcagggtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagcgcgtgggcctgctgggccgcaccggcagcggcaagagcaccctgctgagcgccttcctgcgcctgctgaacaccgagggcgagatccagatcgacggcgtgagctgggacagcatcaccctgcagcagtggcgcaaggccttcggcgtgatcccccagaaggtgttcatcttcagcggcaccttccgcaagaacctggacccctacgagcagtggagcgaccaggagatctggaaggtggccgacgaggtgggcctgagaagcgtgatcgagcagttccccggcaagctggacttcgtgctggtggacggcggctgcgtgctgagccacggccacaagcagctgatgtgcctggcccgcagcgtgctgagcaaggccaagatcctgctgctggacgagcccagcgcccacctggaccccgtgacctaccagatcatcagacgcaccctgaagcaggccttcgccgactgcaccgtgatcctgtgcgagcacaggatcgaggccatgctggagtgccagcagttcctggtgatcgaggagaacaaggtgcgccagtacgacagcatccagaagctgctgaacgagcgcagcctgttccgccaggccatcagccccagcgaccgcgtgaagcttttcccccaccgcaacagcagcaagtgcaagagcaagccccagatcgccgccctgaaggaggagaccgaggaggaggtgcaggacacccgcctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 72 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggagccccctggagaaggctagcgtggtgagcaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagagcttcaagcagaccggagagttcggcgagaagaggaagaacagcatcctgaacccaatcaacagcatcaggaagttcagcatcgtgcagaagaccccactgcagatgaacggcatcgaggaggacagcgacgagcccctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggctgtgaactccagcatcgacgtggacagcctgatgaggtctgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatctccttctcaatcagccctggccagagggtgggcctgctgggaagaaccggcagcggcaagagcaccctgctgagcgccttcctgagactgctgaacaccgagggcgagatccagatcgacggcgtgtcttgggactcaatcaccctgcagcagtggaggaaggccttcggcgtgatcccacagaaggtgttcatcttctctggaaccttcagaaagaacctggacccctacgagcagtggagcgaccaggagatctggaaggtggccgacgaggtgggcctgagatctgtgatcgagcagttccctggcaagctggacttcgtgctggtggacgggggctgcgtgctgagccacggccacaagcagctgatgtgcctggccagatctgtgctgagcaaggccaagatcctgctgctggacgagcccagtgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagcccctccgacagggtgaagctgttcccccaccggaacagcagcaagtgcaagtctaagccccagatcgccgccctgaaggaggagaccgaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 73 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggagccccctggagaaggctagcgtggtgagcaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggatccaccggagccggcaagacctcactgctgatggtgatcatgggagagctggagccttcagagggcaagatcaagcacagtggaagaatcagcttctgcagccagttctcctggatcatgcccggcaccatcaaggagaacatcatcttcggtgtgtcctacgacgagtacagatacagaagcgtgatcaaggcctgccagctggaggaggacatcagcaagttcgcagagaaggacaacatcgtgctgggagagggtggcatcaccctgagcggaggccagagggccagaatctctctggcaagagcagtgtacaaggacgccgacctgtacctgctggactctcccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgtcctggaccgagaccaagaagcagtctttcaagcagaccggagagttcggcgagaagaggaagaactctatcctgaacccaatcaactctatcaggaagttctccatcgtgcagaagaccccactgcagatgaacggcatcgaggaggactctgacgagcccctggagagaaggctgtccctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 74 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggagccccctggagaaggctagcgtggtgagcaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccctgtgctgaaggacatcaacttcaagatcgagagaggacagctgctggccgtggccggatccaccggagccggcaagaccagcctgctgatggtgatcatgggagagctggagcctagcgagggcaagatcaagcacagtggaagaatctcattctgctctcagttcagctggatcatgcctggcaccatcaaggagaacatcatcttcggtgtgtcctacgacgagtacagatacagaagcgtgatcaaggcctgccagctggaggaggacatcagcaagttcgcagagaaggacaacatcgtgctgggagagggtggcatcaccctgagcggaggccagagggccagaatcagcctggcaagagcagtgtacaaggacgccgacctgtacctgctggactctcctttcggatacctggacgtgctgaccgagaaggagatcttcgagagctgcgtgtgcaagctgatggccaacaagaccaggatcctggtgaccagcaagatggagcacctgaagaaggctgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccctgtgagctggaccgagaccaagaagcagtctttcaagcagaccggagagttcggcgagaagaggaagaactctatcctgaacccaatcaacagcatcaggaagttctccatcgtgcagaagaccccactgcagatgaacggcatcgaggaggacagcgacgagcctctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 75 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggagccctctggagaaggctagcgtggtgtccaagctgttcttcagctggaccagaccaatcctgaggaagggctacagacagcgcctggagctgtcagacatctaccagatcccttctgtggactctgctgacaacctgtctgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcctctgctgctgggaagaatcatcgccagctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagtatcggacagctggtgagtctgctgtccaacaacctgaacaagttcgacgagggactggccctggcccacttcgtgtggatcgctcctctgcaggtggccctgctgatggggctgatctgggagctgctgcaggccagcgccttctgcggcctgggcttcctgatcgtgctggccctgttccaggccggcctgggcagaatgatgatgaagtacagagaccagagagctggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttctcagggttcttcgtggtgttcctgtctgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagagcttcaagcagaccggagagttcggcgagaagaggaagaacagcatcctgaacccaatcaacagcatcaggaagttcagcatcgtgcagaagaccccactgcagatgaacggcatcgaggaggacagcgacgagcccctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 76 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggtcgcctctggagaaggctagcgtggtgtccaagctgttcttcagctggaccagaccaatcctgaggaagggctacagacagcgcctggagctgagcgacatctaccagatcccctctgtggacagcgctgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgcctcctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagtatcggacagctggtgagtctgctgagcaacaacctgaacaagttcgacgagggactggccctggcccacttcgtgtggatcgccccactgcaggtggccctgctgatggggctgatctgggagctgctgcaggcctctgccttctgcggcctgggcttcctgatcgtgctggccctgttccaggccggcctgggcagaatgatgatgaagtacagagaccagagagctggcaagatcagcgagagactggtgatcacctcagagatgatcgagaacatccagtctgtgaaggcatactgctgggaggaggccatggagaagatgatcgagaacctgagacagaccgagctgaagctgacccggaaggccgcctacgtgagatacttcaacagcagcgccttcttcttctcagggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagagcttcaagcagaccggagagttcggcgagaagaggaagaacagcatcctgaacccaatcaacagcatcaggaagttcagcatcgtgcagaagaccccactgcagatgaacggcatcgaggaggacagcgacgagcccctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 77 - RNA, 4755 nt, synthetic construct
  misc_feature 1..4755: note = Synthetic construct
  source 1..4755: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagcgcagccccctggagaaggccagcgtggtgagcaagctgttcttcagctggacccgccccatcctgcgcaagggctaccgccagcgcctggagctgagcgacatctaccagatccccagcgtggacagcgccgacaacctgagcgagaagctggagcgcgagtgggaccgcgagctggccagcaagaagaaccccaagctgatcaacgccctgcgccgctgcttcttctggagattcatgttctacggaatcttcctatacctaggggaagtcaccaaagcagtacagccactcctactgggaagaatcatagcaagctacgacccggacaacaaggaggaacgcagtatcgcgatatacctaggcataggcctatgcctactcttcatagtgaggacactgctcctacacccagccatattcggcctacatcacataggaatgcagatgagaatagcaatgttcagtctaatatacaagaagacactaaagctgtcaagccgagtactagacaaaataagtataggacaactagtaagtctcctaagcaacaacctgaacaaattcgacgaaggactagcactagcacatttcgtgtggatcgcaccactacaagtggcactcctcatggggctaatctgggagctactacaggcgagtgccttctgcggactaggtttcctgatagtcctagccctattccaggcagggctagggagaatgatgatgaagtacagagaccagagagcagggaagatcagtgaaagactagtgataacctcagaaatgatagaaaacatccaaagtgtaaaggcatactgctgggaagaagcaatggagaaaatgatagaaaacctaagacaaacagaactgaaactgacacggaaggcagcctacgtgagatacttcaacagctcagccttcttcttctcagggttcttcgtggtgttcctgagcgtgctgccctacgccctgatcaagggcatcatcctgcgcaagatcttcaccaccatctcattctgcatagtactgcgcatggcggtcacacggcaattcccctgggcagtacaaacatggtacgacagtctaggagcaataaacaaaatacaggacttcctacaaaagcaagaatacaagacactagaatacaacctaacgaccaccgaggtggtgatggagaacgtgaccgccttctgggaggagggcttcggcgagctgttcgagaaggccaagcagaacaacaacaaccgcaagaccagcaacggcgacgacagcctgttcttcagcaacttcagcctgctgggcacccccgtgctgaaggacatcaacttcaagatcgagcgcggccagctgctggccgtggccggcagcaccggcgccggcaagaccagcctgctgatggtgatcatgggcgagctggagcccagcgagggcaagatcaagcacagcggccgcatcagcttctgcagccagttcagctggatcatgcccggcaccatcaaggagaacatcatcttcggcgtgagctacgacgagtaccgctaccgcagcgtgatcaaggcctgccagctggaggaggacatcagcaagttcgccgagaaggacaacatcgtgctgggcgagggcggcatcaccctgagcggcggccagcgcgcccgcatcagcctggcccgcgccgtgtacaaggacgccgacctgtacctgctggacagccccttcggctacctggacgtgctgaccgagaaggagatcttcgagagctgcgtgtgcaagctgatggccaacaagacccgcatcctggtgaccagcaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagcgccgcaacagcatcctgaccgagaccctgcaccgcttcagcctggagggcgacgcccccgtgagctggaccgagaccaagaagcagagcttcaagcagaccggcgagttcggcgagaagcgcaagaacagcatcctgaaccccatcaacagcatccgcaagttcagcatcgtgcagaagaccccactgcagatgaacggcatcgaggaggacagcgacgagcccctggagcgccgcctgagcctggtgcccgacagcgagcagggcgaggccatcctgccccgcatcagcgtgatcagcaccggccccaccctgcaggcccgccgccgccagagcgtgctgaacctgatgacccacagcgtgaaccagggccagaacatccaccgcaagaccaccgccagcacccgcaaggtgagcctggccccacaggccaacctgaccgagctggacatctacagccgccgcctgagccaggagaccggcctggagatcagcgaggagatcaacgaggaggacctgaaggagtgcttcttcgacgacatggagagcatccccgccgtgaccacctggaacacctacctgcgctacatcaccgtgcacaagagcctaatattcgtgctaatatggtgcctagtaatattcctggcagaggtggcagcaagtctagtagtgctgtggctcctaggaaacacaccactacaagacaaagggaacagtacacatagtagaaacaacagctacgcagtgataatcaccagcaccagttcgtactacgtgttctacatatacgtgggagtagccgacacactactagcaatgggattcttcagaggtctaccactggtgcatacactaatcacagtgtcgaaaatactacaccacaaaatgctacatagtgtactacaagcaccaatgtcaaccctcaacacgctaaaagcaggtgggatactaaacagattcagcaaagacatagcaatactagacgacctactgccactaaccatattcgacttcatccagctactactaatagtgataggagcaatagcagtagtcgcagtactacaaccctacatcttcgtagcaacagtgccagtgatagtggcattcataatgctaagagcatacttcctccaaacctcacagcaactcaaacaactggaaagtgaaggcaggagtccaatattcacacatctagtaacaagcctaaaaggactatggacactacgagccttcggacggcagccatacttcgaaacactgttccacaaagcactgaacctacatacagccaactggttcctatacctgtcaacactgcgctggttccaaatgagaatagaaatgatattcgtcatcttcttcatagcagtaaccttcatcagcatcctgaccaccggcgagggcgagggccgcgtgggcataatcctgacactagccatgaacatcatgagtacactacagtgggcagtaaacagcagcatagacgtggacagcctaatgcgaagtgtgagccgagtcttcaagttcatagacatgccaacagaaggtaaaccaaccaagtcaaccaaaccatacaagaacggccaactctcgaaagtaatgataatagagaactcacacgtgaagaaagacgacatctggccctcagggggccagatgaccgtgaaggacctgaccgccaagtacaccgagggcggcaacgccatcctggagaacatcagcttcagcatcagccccggccagcgcgtgggcctgctgggccgcaccggcagcggcaagagcaccctgctgagcgccttcctgcgcctgctgaacaccgagggcgagatccagatcgacggcgtgagctgggacagcatcaccctgcagcagtggcgcaaggccttcggcgtgatcccccagaaggtgttcatcttcagcggcaccttccgcaagaacctggacccctacgagcagtggagcgaccaggagatctggaaggtggccgacgaggtgggcctgcgcagcgtgatcgagcagttccccggcaagctggacttcgtgctggtggacggcggctgcgtgctgagccacggccacaagcagctgatgtgcctggcccgcagcgtgctgagcaaggccaagatcctgctgctggacgagcccagcgcccacctggaccccgtgacctaccagatcatccgccgcaccctgaagcaggccttcgccgactgcaccgtgatcctgtgcgagcaccgcatcgaggccatgctggagtgccagcagttcctggtgatcgaggagaacaaggtgcgccagtacgacagcatccagaagctgctgaacgagcgcagcctgttccgccaggccatcagccccagcgaccgcgtgaagctgttcccccaccgcaacagcagcaagtgcaagagcaagccccagatcgccgccctgaaggaggagaccgaggaggaggtgcaggacacccgcctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 78 - RNA, 4671 nt, synthetic construct
  misc_feature 1..4671: note = Synthetic construct
  source 1..4671: mol_type = other RNA
acgcgaaaaaatgcgtacaacaaacttgcgtaaaccaaaaaaatgccaccatgcagaggagccccctggagaaggctagcgtggtgagcaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagagcttcaagcagaccggagagttcggcgagaagaggaagaacagcatcctgaacccaatcaacagcatcaggaagttcagcatcgtgcagaagaccccactgcagatgaacggcatcgaggaggacagcgacgagcccctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 79 - RNA, 4773 nt, synthetic construct
  misc_feature 1..4773: note = Synthetic construct
  source 1..4773: mol_type = other RNA
agcgcagggcggtaactctgggcggggctgggctccagggctggacagcacagtccctctgaactgcacagagacctcgcaggccccgagaactgtcgcccttccacgccaccatgcagaggagccccctggagaaggctagcgtggtgagcaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagagcttcaagcagaccggagagttcggcgagaagaggaagaacagcatcctgaacccaatcaacagcatcaggaagttcagcatcgtgcagaagaccccactgcagatgaacggcatcgaggaggacagcgacgagcccctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtagataagtgaactcgagatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggccaatctag

SEQ ID NO: 80 - RNA, 4746 nt, synthetic construct
  misc_feature 1..4746: note = Synthetic construct
  source 1..4746: mol_type = other RNA
gcatggggaggggcggccctcaaacgggtcattgccattaatagagacctcaaacaccgcctgctaaaaatacccgactggaggagcataaaagcgcagccgagcccagcgccccgcacttttctgagcagacgtccagagcagagtcagccagccaccatgcagaggagccccctggagaaggctagcgtggtgagcaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagagcttcaagcagaccggagagttcggcgagaagaggaagaacagcatcctgaacccaatcaacagcatcaggaagttcagcatcgtgcagaagaccccactgcagatgaacggcatcgaggaggacagcgacgagcccctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtagataagtgaactcgagagccttagcccggatgcccacccctgctgccgccactggctgtgcctcccccgccacctgtgtgttcttttgatacatttatcttctgtttttctcaaataaagttcaaagcaaccacctgtcatctag

SEQ ID NO: 81 - RNA, 4651 nt, synthetic construct
  misc_feature 1..4651: note = Synthetic construct
  source 1..4651: mol_type = other RNA
agcaaaagcaggtagatattgaaagccaccatgcagaggagccccctggagaaggctagcgtggtgagcaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagagcttcaagcagaccggagagttcggcgagaagaggaagaacagcatcctgaacccaatcaacagcatcaggaagttcagcatcgtgcagaagaccccactgcagatgaacggcatcgaggaggacagcgacgagcccctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 82 - RNA, 4600 nt, synthetic construct
  misc_feature 1..4600: note = Synthetic construct
  source 1..4600: mol_type = other RNA
attattacatcaaaacaaaaagccgccaccatgcccaggagccccctggagaaggctagcgtggtgagcaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagagcttcaagcagaccggagagttcggcgagaagaggaagaacagcatcctgaacccaatcaacagcatcaggaagttcagcatcgtgcagaagaccccactgcagatgaacggcatcgaggaggacagcgacgagcccctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtagataagtgaactcgaggctggagcctcggtagccgttcctcctgcccgctgggcctcccaacgggccctcctcccctccttgcaccggcccttcctggtctttgaataaagtctgagtgggcatctag

SEQ ID NO: 83 - RNA, 4600 nt, synthetic construct
  misc_feature 1..4600: note = Synthetic construct
  source 1..4600: mol_type = other RNA
attattacatcaaaacaaaaagccgccaccatgcccaggagccccctggagaaggctagcgtggtgagcaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagagcttcaagcagaccggagagttcggcgagaagaggaagaacagcatcctgaacccaatcaacagcatcaggaagttcagcatcgtgcagaagaccccactgcagatgaacggcatcgaggaggacagcgacgagcccctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagagagtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtagataagtgaactcgaggctggagcctcggtagccgttcctcctgcccgctgggcctcccaacgggccctcctcccctccttgcaccggcccttcctggtctttgaataaagtctgagtgggcatctag

SEQ ID NO: 84 - RNA, 4782 nt, synthetic construct
  misc_feature 1..4782: note = Synthetic construct
  source 1..4782: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggtcgcctctggagaaggccagcgtggtgtccaagctgttcttcagctggaccagaccaatcctgaggaagggctacagacagcgcctggagctgtcagacatctaccagatcccttctgtggactctgctgacaacctgtctgagaagctggagagagagtgggacagagagctggccagcaagaagaaccctaagctgatcaacgccctgcggaggtgcttcttctggagattcatgttctacggaatcttcctgtacctgggggaggtgaccaaggccgtgcagcctctgctgctgggaagaatcatcgcctcctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagtatcggacagctggtgagtctgctgtccaacaacctgaacaagttcgacgagggactggccctggcccacttcgtgtggatcgctcctctgcaggtggccctgctgatggggctgatctgggagctgctgcaggcctctgccttctgcggcctgggcttcctgatcgtgctggccctgttccaggccggcctgggcagaatgatgatgaagtacagagaccagagagctggcaagatcagcgagagactggtgatcacctcagagatgatcgagaacatccagtctgtgaaggcatactgctgggaggaggccatggagaagatgatcgagaacctgagacagaccgagctgaagctgacccggaaggccgcctacgtgagatacttcaacagcagcgccttcttcttctcagggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccctgtgctgaaggacatcaacttcaagatcgagagaggacagctgctggccgtggccggatccaccggagccggcaagacctcactgctgatggtgatcatgggagagctggagccttcagagggcaagatcaagcacagtggaagaatctcattctgctctcagttctcctggatcatgcctggcaccatcaaggagaacatcatcttcggtgtgtcctacgacgagtacagatacagaagcgtgatcaaggcctgccagctggaggaggacatctccaagttcgcagagaaggacaacatcgtgctgggagagggtggcatcaccctgagcggaggccagagggccagaatctctctggcaagagcagtgtacaaggacgctgacctgtacctgctggactctcctttcggatacctggacgtgctgaccgagaaggagatcttcgagagctgcgtgtgcaagctgatggccaacaagaccaggatcctggtgacctctaagatggagcacctgaagaaggctgacaagatcctgatcctgcacgagggcagcagctacttctacgggaccttcagcgagctgcagaacctgcagccagacttcagcagcaagctgatgggctgcgactctttcgaccagttcagcgccgagagaagaaacagcatcctgaccgagaccctgcacaggttcagcctggagggcgacgcccctgtgtcctggaccgagaccaagaagcagtctttcaagcagaccggagagttcggcgagaagaggaagaactctatcctgaacccaatcaactctatcaggaagttctccatcgtgcagaagacccccctgcagatgaacggcatcgaggaggactctgacgagcctctggagagaaggctgtccctggtgccagactctgagcagggcgaggccatcctgcctcgcatcagcgtgatcagcaccggccccaccctgcaggccaggaggaggcagtctgtgctgaacctgatgacccacagcgtgaaccagggccagaacatccacaggaagaccaccgcctccaccaggaaggtgagcctggcccctcaggccaacctgaccgagctggacatctacagcagaaggctgtctcaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgcctctctggtggtgctgtggctgctgggcaacacccctctgcaggacaagggcaacagcacccacagcagaaacaacagctacgccgtgatcatcaccagcaccagcagctactacgtgttctacatctacgtgggagtggccgacaccctgctggccatgggcttcttcagaggtctgccactggtgcacaccctgatcaccgtgagcaagatcctgcaccacaagatgctgcactctgtgctgcaggcccctatgagcaccctgaacaccctgaaggccggtgggatcctgaacagattctccaaggacatcgccatcctggacgacctgctgcctctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagtctgagggcaggagtccaatcttcacccacctggtgaccagcctgaagggactgtggaccctgagggccttcggccggcagccttacttcgagaccctgttccacaaggctctgaacctgcacaccgccaactggttcctgtacctgagcaccctgcgctggttccagatgagaatcgagatgatcttcgtgatcttcttcatcgccgtgaccttcatctccatcctgacctacccctacgacgtgcccgactacgccaccggcgagggagagggaagagtgggcatcatcctgaccctggccatgaacatcatgagcaccctgcagtgggctgtgaactccagcatcgacgtggacagcctgatgaggtctgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatctccttctcaatcagccctggccagagggtgggcctgctgggaagaaccggctcaggcaagagcaccctgctgagcgccttcctgagactgctgaacaccgagggcgagatccagatcgacggcgtgtcttgggactcaatcaccctgcagcagtggaggaaggccttcggcgtgatcccacagaaggtgttcatcttctctggaaccttcagaaagaacctggacccctacgagcagtggagcgaccaggagatctggaaggtggccgacgaggtgggcctgagatctgtgatcgagcagttccctggcaagctggacttcgtgctggtggacgggggctgcgtgctgagccacggccacaagcagctgatgtgcctggccagatctgtgctgagcaaggccaagatcctgctgctggacgagcccagtgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagcccctccgacagggtgaagctgttcccccaccggaacagcagcaagtgcaagtctaagccccagatcgccgccctgaaggaggagaccgaggaggaggtgcaggacaccaggctgtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 85 - RNA, 4782 nt, synthetic construct
  misc_feature 1..4782: note = Synthetic construct
  source 1..4782: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggtcgcctctggagaaggccagcgtggtgtccaagctgttcttcagctggaccagaccaatcctgaggaagggctacagacagcgcctggagctgtcagacatctaccagatcccttctgtggactctgctgacaacctgtctgagaagctggagagagagtgggacagagagctggccagcaagaagaaccctaagctgatcaacgccctgcggaggtgcttcttctggagattcatgttctacggaatcttcctgtacctgggggaggtgaccaaggccgtgcagcctctgctgctgggaagaatcatcgcctcctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagtatcggacagctggtgagtctgctgtccaacaacctgaacaagttcgacgagggactggccctggcccacttcgtgtggatcgctcctctgcaggtggccctgctgatggggctgatctgggagctgctgcaggcctctgccttctgcggcctgggcttcctgatcgtgctggccctgttccaggccggcctgggcagaatgatgatgaagtacagagaccagagagctggcaagatcagcgagagactggtgatcacctcagagatgatcgagaacatccagtctgtgaaggcatactgctgggaggaggccatggagaagatgatcgagaacctgagacagaccgagctgaagctgacccggaaggccgcctacgtgagatacttcaacagcagcgccttcttcttctcagggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccctgtgctgaaggacatcaacttcaagatcgagagaggacagctgctggccgtggccggatccaccggagccggcaagacctcactgctgatggtgatcatgggagagctggagccttcagagggcaagatcaagcacagtggaagaatctcattctgctctcagttctcctggatcatgcctggcaccatcaaggagaacatcatcttcggtgtgtcctacgacgagtacagatacagaagcgtgatcaaggcctgccagctggaggaggacatctccaagttcgcagagaaggacaacatcgtgctgggagagggtggcatcaccctgagcggaggccagagggccagaatctctctggcaagagcagtgtacaaggacgctgacctgtacctgctggactctcctttcggatacctggacgtgctgaccgagaaggagatcttcgagagctgcgtgtgcaagctgatggccaacaagaccaggatcctggtgacctctaagatggagcacctgaagaaggctgacaagatcctgatcctgcacgagggcagcagctacttctacgggaccttcagcgagctgcagaacctgcagccagacttcagcagcaagctgatgggctgcgactctttcgaccagttcagcgccgagagaagaaacagcatcctgaccgagaccctgcacaggttcagcctggagggcgacgcccctgtgtcctggaccgagaccaagaagcagtctttcaagcagaccggagagttcggcgagaagaggaagaactctatcctgaacccaatcaactctatcaggaagttctccatcgtgcagaagacccccctgcagatgaacggcatcgaggaggactctgacgagcctctggagagaaggctgtccctggtgccagactctgagcagggcgaggccatcctgcctcgcatcagcgtgatcagcaccggccccaccctgcaggccaggaggaggcagtctgtgctgaacctgatgacccacagcgtgaaccagggccagaacatccacaggaagaccaccgcctccaccaggaaggtgagcctggcccctcaggccaacctgaccgagctggacatctacagcagaaggctgtctcaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgcctctctggtggtgctgtggctgctgggcaacacccctctgcaggacaagggcaacagcacccacagcagaaacaacagctacgccgtgatcatcaccagcaccagcagctactacgtgttctacatctacgtgggagtggccgacaccctgctggccatgggcttcttcagaggtctgccactggtgcacaccctgatcaccgtgagcaagatcctgcaccacaagatgctgcactctgtgctgcaggcccctatgagcaccctgaacaccctgaaggccggtgggatcctgaacagattctccaaggacatcgccatcctggacgacctgctgcctctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagtctgagggcaggagtccaatcttcacccacctggtgaccagcctgaagggactgtggaccctgagggccttcggccggcagccttacttcgagaccctgttccacaaggctctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggctgtgaactccagcatcgacgtggacagcctgatgaggtctgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatctccttctcaatcagccctggccagagggtgggcctgctgggaagaaccggctcaggcaagagcaccctgctgagcgccttcctgagactgctgaacaccgagggcgagatccagatcgacggcgtgtcttgggactcaatcaccctgcagcagtggaggaaggccttcggcgtgatcccacagaaggtgttcatcttctctggaaccttcagaaagaacctggacccctacgagcagtggagcgaccaggagatctggaaggtggccgacgaggtgggcctgagatctgtgatcgagcagttccctggcaagctggacttcgtgctggtggacgggggctgcgtgctgagccacggccacaagcagctgatgtgcctggccagatctgtgctgagcaaggccaagatcctgctgctggacgagcccagtgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagcccctccgacagggtgaagctgttcccccaccggaacagcagcaagtgcaagtctaagccccagatcgccgccctgaaggaggagaccgaggaggaggtgcaggacaccaggctgtacccctacgacgtgcccgactacgcctagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 86 - RNA, 4779 nt, synthetic construct
  misc_feature 1..4779: note = Synthetic construct
  source 1..4779: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggtcgcctctggagaaggccagcgtggtgtccaagctgttcttcagctggaccagaccaatcctgaggaagggctacagacagcgcctggagctgtcagacatctaccagatcccttctgtggactctgctgacaacctgtctgagaagctggagagagagtgggacagagagctggccagcaagaagaaccctaagctgatcaacgccctgcggaggtgcttcttctggagattcatgttctacggaatcttcctgtacctgggggaggtgaccaaggccgtgcagcctctgctgctgggaagaatcatcgcctcctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagtatcggacagctggtgagtctgctgtccaacaacctgaacaagttcgacgagggactggccctggcccacttcgtgtggatcgctcctctgcaggtggccctgctgatggggctgatctgggagctgctgcaggcctctgccttctgcggcctgggcttcctgatcgtgctggccctgttccaggccggcctgggcagaatgatgatgaagtacagagaccagagagctggcaagatcagcgagagactggtgatcacctcagagatgatcgagaacatccagtctgtgaaggcatactgctgggaggaggccatggagaagatgatcgagaacctgagacagaccgagctgaagctgacccggaaggccgcctacgtgagatacttcaacagcagcgccttcttcttctcagggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccctgtgctgaaggacatcaacttcaagatcgagagaggacagctgctggccgtggccggatccaccggagccggcaagacctcactgctgatggtgatcatgggagagctggagccttcagagggcaagatcaagcacagtggaagaatctcattctgctctcagttctcctggatcatgcctggcaccatcaaggagaacatcatcttcggtgtgtcctacgacgagtacagatacagaagcgtgatcaaggcctgccagctggaggaggacatctccaagttcgcagagaaggacaacatcgtgctgggagagggtggcatcaccctgagcggaggccagagggccagaatctctctggcaagagcagtgtacaaggacgctgacctgtacctgctggactctcctttcggatacctggacgtgctgaccgagaaggagatcttcgagagctgcgtgtgcaagctgatggccaacaagaccaggatcctggtgacctctaagatggagcacctgaagaaggctgacaagatcctgatcctgcacgagggcagcagctacttctacgggaccttcagcgagctgcagaacctgcagccagacttcagcagcaagctgatgggctgcgactctttcgaccagttcagcgccgagagaagaaacagcatcctgaccgagaccctgcacaggttcagcctggagggcgacgcccctgtgtcctggaccgagaccaagaagcagtctttcaagcagaccggagagttcggcgagaagaggaagaactctatcctgaacccaatcaactctatcaggaagttctccatcgtgcagaagacccccctgcagatgaacggcatcgaggaggactctgacgagcctctggagagaaggctgtccctggtgccagactctgagcagggcgaggccatcctgcctcgcatcagcgtgatcagcaccggccccaccctgcaggccaggaggaggcagtctgtgctgaacctgatgacccacagcgtgaaccagggccagaacatccacaggaagaccaccgcctccaccaggaaggtgagcctggcccctcaggccaacctgaccgagctggacatctacagcagaaggctgtctcaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgcctctctggtggtgctgtggctgctgggcaacacccctctgcaggacaagggcaacagcacccacagcagaaacaacagctacgccgtgatcatcaccagcaccagcagctactacgtgttctacatctacgtgggagtggccgacaccctgctggccatgggcttcttcagaggtctgccactggtgcacaccctgatcaccgtgagcaagatcctgcaccacaagatgctgcactctgtgctgcaggcccctatgagcaccctgaacaccctgaaggccggtgggatcctgaacagattctccaaggacatcgccatcctggacgacctgctgcctctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagtctgagggcaggagtccaatcttcacccacctggtgaccagcctgaagggactgtggaccctgagggccttcggccggcagccttacttcgagaccctgttccacaaggctctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggctgtgaactccagcatcgacgtggacagcctgatgaggtctgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatctccttctcaatcagccctggccagagggtgggcctgctgggaagaaccggctcaggcaagagcaccctgctgagcgccttcctgagactgctgaacaccgagggcgagatccagatcgacggcgtgtcttgggactcaatcaccctgcagcagtggaggaaggccttcggcgtgatcccacagaaggtgttcatcttctctggaaccttcagaaagaacctggacccctacgagcagtggagcgaccaggagatctggaaggtggccgacgaggtgggcctgagatctgtgatcgagcagttccctggcaagctggacttcgtgctggtggacgggggctgcgtgctgagccacggccacaagcagctgatgtgcctggccagatctgtgctgagcaaggccaagatcctgctgctggacgagcccagtgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagcccctccgacagggtgaagctgttcccccaccggaacagcagcaagtgcaagtctaagccccagatcgccgccctgaaggaggagaccgaggaggaggtgcaggacaccaggctggactacaaggacgatgacgataagtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 87 - RNA, 4899 nt, synthetic construct
  misc_feature 1..4899: note = Synthetic construct
  source 1..4899: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggtcgcctctggagaaggccagcgtggtgtccaagctgttcttcagctggaccagaccaatcctgaggaagggctacagacagcgcctggagctgtcagacatctaccagatcccttctgtggactctgctgacaacctgtctgagaagctggagagagagtgggacagagagctggccagcaagaagaaccctaagctgatcaacgccctgcggaggtgcttcttctggagattcatgttctacggaatcttcctgtacctgggggaggtgaccaaggccgtgcagcctctgctgctgggaagaatcatcgcctcctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagtatcggacagctggtgagtctgctgtccaacaacctgaacaagttcgacgagggactggccctggcccacttcgtgtggatcgctcctctgcaggtggccctgctgatggggctgatctgggagctgctgcaggcctctgccttctgcggcctgggcttcctgatcgtgctggccctgttccaggccggcctgggcagaatgatgatgaagtacagagaccagagagctggcaagatcagcgagagactggtgatcacctcagagatgatcgagaacatccagtctgtgaaggcatactgctgggaggaggccatggagaagatgatcgagaacctgagacagaccgagctgaagctgacccggaaggccgcctacgtgagatacttcaacagcagcgccttcttcttctcagggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccctgtgctgaaggacatcaacttcaagatcgagagaggacagctgctggccgtggccggatccaccggagccggcaagacctcactgctgatggtgatcatgggagagctggagccttcagagggcaagatcaagcacagtggaagaatctcattctgctctcagttctcctggatcatgcctggcaccatcaaggagaacatcatcttcggtgtgtcctacgacgagtacagatacagaagcgtgatcaaggcctgccagctggaggaggacatctccaagttcgcagagaaggacaacatcgtgctgggagagggtggcatcaccctgagcggaggccagagggccagaatctctctggcaagagcagtgtacaaggacgctgacctgtacctgctggactctcctttcggatacctggacgtgctgaccgagaaggagatcttcgagagctgcgtgtgcaagctgatggccaacaagaccaggatcctggtgacctctaagatggagcacctgaagaaggctgacaagatcctgatcctgcacgagggcagcagctacttctacgggaccttcagcgagctgcagaacctgcagccagacttcagcagcaagctgatgggctgcgactctttcgaccagttcagcgccgagagaagaaacagcatcctgaccgagaccctgcacaggttcagcctggagggcgacgcccctgtgtcctggaccgagaccaagaagcagtctttcaagcagaccggagagttcggcgagaagaggaagaactctatcctgaacccaatcaactctatcaggaagttctccatcgtgcagaagacccccctgcagatgaacggcatcgaggaggactctgacgagcctctggagagaaggctgtccctggtgccagactctgagcagggcgaggccatcctgcctcgcatcagcgtgatcagcaccggccccaccctgcaggccaggaggaggcagtctgtgctgaacctgatgacccacagcgtgaaccagggccagaacatccacaggaagaccaccgcctccaccaggaaggtgagcctggcccctcaggccaacctgaccgagctggacatctacagcagaaggctgtctcaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgcctctctggtggtgctgtggctgctgggcaacacccctctgcaggacaagggcaacagcacccacagcagaaacaacagctacgccgtgatcatcaccagcaccagcagctactacgtgttctacatctacgtgggagtggccgacaccctgctggccatgggcttcttcagaggtctgccactggtgcacaccctgatcaccgtgagcaagatcctgcaccacaagatgctgcactctgtgctgcaggcccctatgagcaccctgaacaccctgaaggccggtgggatcctgaacagattctccaaggacatcgccatcctggacgacctgctgcctctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagtctgagggcaggagtccaatcttcacccacctggtgaccagcctgaagggactgtggaccctgagggccttcggccggcagccttacttcgagaccctgttccacaaggctctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggctgtgaactccagcatcgacgtggacagcctgatgaggtctgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatctccttctcaatcagccctggccagagggtgggcctgctgggaagaaccggctcaggcaagagcaccctgctgagcgccttcctgagactgctgaacaccgagggcgagatccagatcgacggcgtgtcttgggactcaatcaccctgcagcagtggaggaaggccttcggcgtgatcccacagaaggtgttcatcttctctggaaccttcagaaagaacctggacccctacgagcagtggagcgaccaggagatctggaaggtggccgacgaggtgggcctgagatctgtgatcgagcagttccctggcaagctggacttcgtgctggtggacgggggctgcgtgctgagccacggccacaagcagctgatgtgcctggccagatctgtgctgagcaaggccaagatcctgctgctggacgagcccagtgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagcccctccgacagggtgaagctgttcccccaccggaacagcagcaagtgcaagtctaagccccagatcgccgccctgaaggaggagaccgaggaggaggtgcaggacaccaggctgggcggcggcagcggcgagcagaaactgatcagcgaagaggatctgaacggcggcggcagcggcgagcagaaactgatcagcgaagaggatctgaacggcggcggcagcggcgagcagaaactgatcagcgaagaggatctgaactagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 88 - RNA, 4788 nt, synthetic construct
  misc_feature 1..4788: note = Synthetic construct
  source 1..4788: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggtcgcctctggagaaggccagcgtggtgtccaagctgttcttcagctggaccagaccaatcctgaggaagggctacagacagcgcctggagctgtcagacatctaccagatcccttctgtggactctgctgacaacctgtctgagaagctggagagagagtgggacagagagctggccagcaagaagaaccctaagctgatcaacgccctgcggaggtgcttcttctggagattcatgttctacggaatcttcctgtacctgggggaggtgaccaaggccgtgcagcctctgctgctgggaagaatcatcgcctcctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagtatcggacagctggtgagtctgctgtccaacaacctgaacaagttcgacgagggactggccctggcccacttcgtgtggatcgctcctctgcaggtggccctgctgatggggctgatctgggagctgctgcaggcctctgccttctgcggcctgggcttcctgatcgtgctggccctgttccaggccggcctgggcagaatgatgatgaagtacagagaccagagagctggcaagatcagcgagagactggtgatcacctcagagatgatcgagaacatccagtctgtgaaggcatactgctgggaggaggccatggagaagatgatcgagaacctgagacagaccgagctgaagctgacccggaaggccgcctacgtgagatacttcaacagcagcgccttcttcttctcagggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccctgtgctgaaggacatcaacttcaagatcgagagaggacagctgctggccgtggccggatccaccggagccggcaagacctcactgctgatggtgatcatgggagagctggagccttcagagggcaagatcaagcacagtggaagaatctcattctgctctcagttctcctggatcatgcctggcaccatcaaggagaacatcatcttcggtgtgtcctacgacgagtacagatacagaagcgtgatcaaggcctgccagctggaggaggacatctccaagttcgcagagaaggacaacatcgtgctgggagagggtggcatcaccctgagcggaggccagagggccagaatctctctggcaagagcagtgtacaaggacgctgacctgtacctgctggactctcctttcggatacctggacgtgctgaccgagaaggagatcttcgagagctgcgtgtgcaagctgatggccaacaagaccaggatcctggtgacctctaagatggagcacctgaagaaggctgacaagatcctgatcctgcacgagggcagcagctacttctacgggaccttcagcgagctgcagaacctgcagccagacttcagcagcaagctgatgggctgcgactctttcgaccagttcagcgccgagagaagaaacagcatcctgaccgagaccctgcacaggttcagcctggagggcgacgcccctgtgtcctggaccgagaccaagaagcagtctttcaagcagaccggagagttcggcgagaagaggaagaactctatcctgaacccaatcaactctatcaggaagttctccatcgtgcagaagacccccctgcagatgaacggcatcgaggaggactctgacgagcctctggagagaaggctgtccctggtgccagactctgagcagggcgaggccatcctgcctcgcatcagcgtgatcagcaccggccccaccctgcaggccaggaggaggcagtctgtgctgaacctgatgacccacagcgtgaaccagggccagaacatccacaggaagaccaccgcctccaccaggaaggtgagcctggcccctcaggccaacctgaccgagctggacatctacagcagaaggctgtctcaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgcctctctggtggtgctgtggctgctgggcaacacccctctgcaggacaagggcaacagcacccacagcagaaacaacagctacgccgtgatcatcaccagcaccagcagctactacgtgttctacatctacgtgggagtggccgacaccctgctggccatgggcttcttcagaggtctgccactggtgcacaccctgatcaccgtgagcaagatcctgcaccacaagatgctgcactctgtgctgcaggcccctatgagcaccctgaacaccctgaaggccggtgggatcctgaacagattctccaaggacatcgccatcctggacgacctgctgcctctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagtctgagggcaggagtccaatcttcacccacctggtgaccagcctgaagggactgtggaccctgagggccttcggccggcagccttacttcgagaccctgttccacaaggctctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggctgtgaactccagcatcgacgtggacagcctgatgaggtctgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatctccttctcaatcagccctggccagagggtgggcctgctgggaagaaccggctcaggcaagagcaccctgctgagcgccttcctgagactgctgaacaccgagggcgagatccagatcgacggcgtgtcttgggactcaatcaccctgcagcagtggaggaaggccttcggcgtgatcccacagaaggtgttcatcttctctggaaccttcagaaagaacctggacccctacgagcagtggagcgaccaggagatctggaaggtggccgacgaggtgggcctgagatctgtgatcgagcagttccctggcaagctggacttcgtgctggtggacgggggctgcgtgctgagccacggccacaagcagctgatgtgcctggccagatctgtgctgagcaaggccaagatcctgctgctggacgagcccagtgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagcccctccgacagggtgaagctgttcccccaccggaacagcagcaagtgcaagtctaagccccagatcgccgccctgaaggaggagaccgaggaggaggtgcaggacaccaggctggtgagcggctggcggctgttcaagaagattagctagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 89 - RNA, 5496 nt, synthetic construct
  misc_feature 1..5496: note = Synthetic construct
  source 1..5496: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatagccaccatgcagaggtcgcctctggagaaggccagcgtggtgtccaagctgttcttcagctggaccagaccaatcctgaggaagggctacagacagcgcctggagctgtcagacatctaccagatcccttctgtggactctgctgacaacctgtctgagaagctggagagagagtgggacagagagctggccagcaagaagaaccctaagctgatcaacgccctgcggaggtgcttcttctggagattcatgttctacggaatcttcctgtacctgggggaggtgaccaaggccgtgcagcctctgctgctgggaagaatcatcgcctcctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagtatcggacagctggtgagtctgctgtccaacaacctgaacaagttcgacgagggactggccctggcccacttcgtgtggatcgctcctctgcaggtggccctgctgatggggctgatctgggagctgctgcaggcctctgccttctgcggcctgggcttcctgatcgtgctggccctgttccaggccggcctgggcagaatgatgatgaagtacagagaccagagagctggcaagatcagcgagagactggtgatcacctcagagatgatcgagaacatccagtctgtgaaggcatactgctgggaggaggccatggagaagatgatcgagaacctgagacagaccgagctgaagctgacccggaaggccgcctacgtgagatacttcaacagcagcgccttcttcttctcagggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccctgtgctgaaggacatcaacttcaagatcgagagaggacagctgctggccgtggccggatccaccggagccggcaagacctcactgctgatggtgatcatgggagagctggagccttcagagggcaagatcaagcacagtggaagaatctcattctgctctcagttctcctggatcatgcctggcaccatcaaggagaacatcatcttcggtgtgtcctacgacgagtacagatacagaagcgtgatcaaggcctgccagctggaggaggacatctccaagttcgcagagaaggacaacatcgtgctgggagagggtggcatcaccctgagcggaggccagagggccagaatctctctggcaagagcagtgtacaaggacgctgacctgtacctgctggactctcctttcggatacctggacgtgctgaccgagaaggagatcttcgagagctgcgtgtgcaagctgatggccaacaagaccaggatcctggtgacctctaagatggagcacctgaagaaggctgacaagatcctgatcctgcacgagggcagcagctacttctacgggaccttcagcgagctgcagaacctgcagccagacttcagcagcaagctgatgggctgcgactctttcgaccagttcagcgccgagagaagaaacagcatcctgaccgagaccctgcacaggttcagcctggagggcgacgcccctgtgtcctggaccgagaccaagaagcagtctttcaagcagaccggagagttcggcgagaagaggaagaactctatcctgaacccaatcaactctatcaggaagttctccatcgtgcagaagacccccctgcagatgaacggcatcgaggaggactctgacgagcctctggagagaaggctgtccctggtgccagactctgagcagggcgaggccatcctgcctcgcatcagcgtgatcagcaccggccccaccctgcaggccaggaggaggcagtctgtgctgaacctgatgacccacagcgtgaaccagggccagaacatccacaggaagaccaccgcctccaccaggaaggtgagcctggcccctcaggccaacctgaccgagctggacatctacagcagaaggctgtctcaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgcctctctggtggtgctgtggctgctgggcaacacccctctgcaggacaagggcaacagcacccacagcagaaacaacagctacgccgtgatcatcaccagcaccagcagctactacgtgttctacatctacgtgggagtggccgacaccctgctggccatgggcttcttcagaggtctgccactggtgcacaccctgatcaccgtgagcaagatcctgcaccacaagatgctgcactctgtgctgcaggcccctatgagcaccctgaacaccctgaaggccggtgggatcctgaacagattctccaaggacatcgccatcctggacgacctgctgcctctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagtctgagggcaggagtccaatcttcacccacctggtgaccagcctgaagggactgtggaccctgagggccttcggccggcagccttacttcgagaccctgttccacaaggctctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggctgtgaactccagcatcgacgtggacagcctgatgaggtctgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatctccttctcaatcagccctggccagagggtgggcctgctgggaagaaccggctcaggcaagagcaccctgctgagcgccttcctgagactgctgaacaccgagggcgagatccagatcgacggcgtgtcttgggactcaatcaccctgcagcagtggaggaaggccttcggcgtgatcccacagaaggtgttcatcttctctggaaccttcagaaagaacctggacccctacgagcagtggagcgaccaggagatctggaaggtggccgacgaggtgggcctgagatctgtgatcgagcagttccctggcaagctggacttcgtgctggtggacgggggctgcgtgctgagccacggccacaagcagctgatgtgcctggccagatctgtgctgagcaaggccaagatcctgctgctggacgagcccagtgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagcccctccgacagggtgaagctgttcccccaccggaacagcagcaagtgcaagtctaagccccagatcgccgccctgaaggaggagaccgaggaggaggtgcaggacaccaggctgggcggcggcggcagcggcggcagcagcgtgagcaagggcgaggagctgttcaccggcgtggtgcccatcctggtggagctggacggcgacgtgaacggccacaagttcagcgtgagcggcgagggcgagggcgacgccacctacggcaagctgaccctgaagttcatctgcaccaccggcaagctgcccgtgccctggcccaccctggtgaccaccctgacctacggcgtgcagtgcttcagcaggtaccccgaccacatgaagcagcacgacttcttcaagagcgccatgcccgagggctacgtgcaggagaggaccatcttcttcaaggacgacggcaactacaagaccagggccgaggtgaagttcgagggcgacaccctggtgaacaggatcgagctgaagggcatcgacttcaaggaggacggcaacatcctgggccacaagctggagtacaactacaacagccacaacgtgtacatcatggccgacaagcagaagaacggcatcaaggtgaacttcaagatcaggcacaacatcgaggacggcagcgtgcagctggccgaccactaccagcagaacacccccatcggcgacggccccgtgctgctgcccgacaaccactacctgagcacccagagcgccctgagcaaggaccccaacgagaagagggaccacatggtgctgctggagttcgtgaccgccgccggcatcaccctgggcatggacgagctgtacaagtagataagtgaactcgagctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacattctag

SEQ ID NO: 90 - RNA, 4746 nt, synthetic construct; identical to SEQ ID NO: 47
  misc_feature 1..4746: note = Synthetic construct
  source 1..4746: mol_type = other RNA

SEQ ID NO: 91 - RNA, 4755 nt, synthetic construct; identical to SEQ ID NO: 53
  misc_feature 1..4755: note = Synthetic construct
  source 1..4755: mol_type = other RNA

SEQ ID NO: 92 - RNA, 4755 nt, synthetic construct; identical to SEQ ID NO: 72
  misc_feature 1..4755: note = Synthetic construct
  source 1..4755: mol_type = other RNA

SEQ ID NO: 93 - protein, 1480 aa, Homo sapiens
MQRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEEGFGELFEKAKQNNNNRKTSNGDDSLFFSNFSLLGTPVLKDINFKIERGQLLAVAGSTGAGKTSLLMVIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFESCVCKLMANKTRILVTSKMEHLKKADKILILHEGSSYFYGTFSELQNLQPDFSSKLMGCDSFDQFSAERRNSILTETLHRFSLEGDAPVSWTETKKQSFKQTGEFGEKRKNSILNPINSIRKFSIVQKTPLQMNGIEEDSDEPLERRLSLVPDSEQGEAILPRISVISTGPTLQARRRQSVLNLMTHSVNQGQNIHRKTTASTRKVSLAPQANLTELDIYSRRLSQETGLEISEEINEEDLKECFFDDMESIPAVTTWNTYLRYITVHKSLIFVLIWCLVIFLAEVAASLVVLWLLGNTPLQDKGNSTHSRNNSYAVIITSTSSYYVFYIYVGVADTLLAMGFFRGLPLVHTLITVSKILHHKMLHSVLQAPMSTLNTLKAGGILNRFSKDIAILDDLLPLTIFDFIQLLLIVIGAIAVVAVLQPYIFVATVPVIVAFIMLRAYFLQTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVGLLGRTGSGKSTLLSAFLRLLNTEGEIQIDGVSWDSITLQQWRKAFGVIPQKVFIFSGTFRKNLDPYEQWSDQEIWKVADEVGLRSVIEQFPGKLDFVLVDGGCVLSHGHKQLMCLARSVLSKAKILLLDEPSAHLDPVTYQIIRRTLKQAFADCTVILCEHRIEAMLECQQFLVIEENKVRQYDSIQKLLNERSLFRQAISPSDRVKLFPHRNSSKCKSKPQIAALKEETEEEVQDTRL

SEQ ID NO: 94 - protein, 1480 aa, Homo sapiens; identical to SEQ ID NO: 93

SEQ ID NO: 95 - protein, 1481 aa, synthetic construct
  REGION 1..1481: note = Synthetic construct
MGQRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEEGFGELFEKAKQNNNNRKTSNGDDSLFFSNFSLLGTPVLKDINFKIERGQLLAVAGSTGAGKTSLLMVIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFESCVCKLMANKTRILVTSKMEHLKKADKILILHEGSSYFYGTFSELQNLQPDFSSKLMGCDSFDQFSAERRNSILTETLHRFSLEGDAPVSWTETKKQSFKQTGEFGEKRKNSILNPINSIRKFSIVQKTPLQMNGIEEDSDEPLERRLSLVPDSEQGEAILPRISVISTGPTLQARRRQSVLNLMTHSVNQGQNIHRKTTASTRKVSLAPQANLTELDIYSRRLSQETGLEISEEINEEDLKECFFDDMESIPAVTTWNTYLRYITVHKSLIFVLIWCLVIFLAEVAASLVVLWLLGNTPLQDKGNSTHSRNNSYAVIITSTSSYYVFYIYVGVADTLLAMGFFRGLPLVHTLITVSKILHHKMLHSVLQAPMSTLNTLKAGGILNRFSKDIAILDDLLPLTIFDFIQLLLIVIGAIAVVAVLQPYIFVATVPVIVAFIMLRAYFLQTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVGLLGRTGSGKSTLLSAFLRLLNTEGEIQIDGVSWDSITLQQWRKAFGVIPQKVFIFSGTFRKNLDPYEQWSDQEIWKVADEVGLRSVIEQFPGKLDFVLVDGGCVLSHGHKQLMCLARSVLSKAKILLLDEPSAHLDPVTYQIIRRTLKQAFADCTVILCEHRIEAMLECQQFLVIEENKVRQYDSIQKLLNERSLFRQAISPSDRVKLFPHRNSSKCKSKPQIAALKEETEEEVQDTRL

SEQ ID NO: 96 - protein, 1480 aa, synthetic construct
  REGION 1..1480: note = Synthetic construct
MPRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEEGFGELFEKAKQNNNNRKTSNGDDSLFFSNFSLLGTPVLKDINFKIERGQLLAVAGSTGAGKTSLLMVIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFESCVCKLMANKTRILVTSKMEHLKKADKILILHEGSSYFYGTFSELQNLQPDFSSKLMGCDSFDQFSAERRNSILTETLHRFSLEGDAPVSWTETKKQSFKQTGEFGEKRKNSILNPINSIRKFSIVQKTPLQMNGIEEDSDEPLERRLSLVPDSEQGEAILPRISVISTGPTLQARRRQSVLNLMTHSVNQGQNIHRKTTASTRKVSLAPQANLTELDIYSRRLSQETGLEISEEINEEDLKECFFDDMESIPAVTTWNTYLRYITVHKSLIFVLIWCLVIFLAEVAASLVVLWLLGNTPLQDKGNSTHSRNNSYAVIITSTSSYYVFYIYVGVADTLLAMGFFRGLPLVHTLITVSKILHHKMLHSVLQAPMSTLNTLKAGGILNRFSKDIAILDDLLPLTIFDFIQLLLIVIGAIAVVAVLQPYIFVATVPVIVAFIMLRAYFLQTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVGLLGRTGSGKSTLLSAFLRLLNTEGEIQIDGVSWDSITLQQWRKAFGVIPQKVFIFSGTFRKNLDPYEQWSDQEIWKVADEVGLRSVIEQFPGKLDFVLVDGGCVLSHGHKQLMCLARSVLSKAKILLLDEPSAHLDPVTYQIIRRTLKQAFADCTVILCEHRIEAMLECQQFLVIEENKVRQYDSIQKLLNERSLFRQAISPSDRVKLFPHRNSSKCKSKPQIAALKEETEEEVQDTRL

SEQ ID NO: 97 - protein, 1480 aa, synthetic construct
  REGION 1..1480: note = Synthetic construct
MPRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEEGFGELFEKAKQNNNNRKTSNGDDSLFFSNFSLLGTPVLKDINFKIERGQLLAVAGSTGAGKTSLLMVIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFESCVCKLMANKTRILVTSKMEHLKKADKILILHEGSSYFYGTFSELQNLQPDFSSKLMGCDSFDQFSAERRNSILTETLHRFSLEGDAPVSWTETKKQSFKQTGEFGEKRKNSILNPINSIRKFSIVQKTPLQMNGIEEDSDEPLERRLSLVPDSEQGEAILPRISVISTGPTLQARRRQSVLNLMTHSVNQGQNIHRKTTASTRKVSLAPQANLTELDIYSRRLSQETGLEISEEINEEDLKECFFDDMESIPAVTTWNTYLRYITVHKSLIFVLIWCLVIFLAEVAASLVVLWLLGNTPLQDKGNSTHSRNNSYAVIITSTSSYYVFYIYVGVADTLLAMGFFRGLPLVHTLITVSKILHHKMLHSVLQAPMSTLNTLKAGGILNRFSKDIAILDDLLPLTIFDFIQLLLIVIGAIAVVAVLQPYIFVATVPVIVAFIMLRAYFLQTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVGLLGRTGSGKSTLLSAFLRLLNTEGEIQIDGVSWDSITLQQWRKAFGVIPQRVFIFSGTFRKNLDPYEQWSDQEIWKVADEVGLRSVIEQFPGKLDFVLVDGGCVLSHGHKQLMCLARSVLSKAKILLLDEPSAHLDPVTYQIIRRTLKQAFADCTVILCEHRIEAMLECQQFLVIEENKVRQYDSIQKLLNERSLFRQAISPSDRVKLFPHRNSSKCKSKPQIAALKEETEEEVQDTRL

SEQ ID NO: 98 - protein, 1480 aa, synthetic construct; identical to SEQ ID NO: 93
  REGION 1..1480: note = Synthetic construct

SEQ ID NO: 99 - protein, 1480 aa, synthetic construct; identical to SEQ ID NO: 93
  REGION 1..1480: note = Synthetic construct

SEQ ID NO: 100 - RNA, 4443 nt, synthetic construct
  misc_feature 1..4443: note = Synthetic construct
  source 1..4443: mol_type = other RNA
atgcagcgcagccccctcgagaaggccagcgtggtgagcaagctgttcttcagctggacccgccccatcctgcgcaagggctaccgccagcgcctggagctgagcgacatctaccagatccccagcgtggacagcgccgacaacctgagcgagaagctggagcgcgagtgggaccgcgagctggccagcaagaagaaccccaagctgatcaacgccctgcgccgctgcttcttctggcgcttcatgttctacggcatcttcctgtacctgggcgaggtgaccaaggccgtgcagcccctgctgctgggccgcatcatcgccagctacgaccccgacaacaaggaggagcgcagcatcgccatctacctgggcatcggcctgtgcctgctgttcatcgtgcgcaccctgctgctgcaccccgccatcttcggcctgcaccacatcggcatgcagatgcgcatcgccatgttcagcctgatctacaagaagaccctgaagctgagcagccgcgtgctggacaagatcagcatcggccagctggtgagcctgctgagcaacaacctgaacaagttcgacgagggcctggccctggcccacttcgtgtggatcgcccccctgcaggtggccctgctgatgggcctgatctgggagctgctgcaggccagcgccttctgcggcctgggcttcctgatcgtgctggccctgttccaggccggcctgggccgcatgatgatgaagtaccgcgaccagcgcgccggcaagatcagcgagcgcctggtgatcaccagcgagatgatcgagaacatccagagcgtgaaggcctactgctgggaggaggccatggagaagatgatcgagaacctgcgccagaccgagctgaagctgacccgcaaggccgcctacgtgcgctacttcaacagcagcgccttcttcttcagcggcttcttcgtggtgttcctgagcgtgctgccctacgccctgatcaagggcatcatcctgcgcaagatcttcaccaccatcagcttctgcatcgtgctgcgcatggccgtgacccgccagttcccctgggccgtgcagacctggtacgacagcctgggcgccatcaacaagatccaggacttcctgcagaagcaggagtacaagaccctggagtacaacctgaccaccaccgaggtggtgatggagaacgtgaccgccttctgggaggagggcttcggcgagctgttcgagaaggccaagcagaacaacaacaaccgcaagaccagcaacggcgacgacagcctgttcttcagcaacttcagcctgctgggcacccccgtgctgaaggacatcaacttcaagatcgagcgcggccagctgctggccgtggccggcagcaccggcgccggcaagaccagcctgctgatggtgatcatgggcgagctggagcccagcgagggcaagatcaagcacagcggccgcatcagcttctgcagccagttcagctggatcatgcccggcaccatcaaggagaacatcatcttcggcgtgagctacgacgagtaccgctaccgcagcgtgatcaaggcctgccagctggaggaggacatcagcaagttcgccgagaaggacaacatcgtgctgggcgagggcggcatcaccctgagcggcggccagcgcgcccgcatcagcctggcccgcgccgtgtacaaggacgccgacctgtacctgctggacagccccttcggctacctggacgtgctgaccgagaaggagatcttcgagagctgcgtgtgcaagctgatggccaacaagacccgcatcctggtgaccagcaagatggagcacctgaagaaggccgacaagatcctgatcctgcacgagggcagcagctacttctacggcaccttcagcgagctgcagaacctgcagcccgacttcagcagcaagctgatgggctgcgacagcttcgaccagttcagcgccgagcgccgcaacagcatcctgaccgagaccctgcaccgcttcagcctggagggcgacgcccccgtgagctggaccgagaccaagaagcagagcttcaagcagaccggcgagttcggcgagaagcgcaagaacagcatcctgaaccccatcaacagcatccgcaagttcagcatcgtgcagaagacccccctgcagatgaacggcatcgaggaggacagcgacgagcccctggagcgccgcctgagcctggtgcccgacagcgagcagggcgaggccatcctgccccgcatcagcgtgatcagcaccggccccaccctgcaggcccgccgccgccagagcgtgctgaacctgatgacccacagcgtgaaccagggccagaacatccaccgcaagaccaccgccagcacccgcaaagtgagcctggccccccaggccaacctgaccgagctggacatctacagccgccgcctgagccaggagaccggcctggagatcagcgaggagatcaacgaggaggacctgaaggagtgcttcttcgacgacatggagagcatccccgccgtgaccacctggaacacctacctgcgctacatcaccgtgcacaagagcctgatcttcgtgctgatctggtgcctggtgatcttcctggccgaggtggccgccagcctggtggtgctgtggctgctgggcaacacccccctgcaggacaagggcaacagcacccacagccgcaacaacagctacgccgtgatcatcaccagcaccagcagctactacgtgttctacatctacgtgggcgtggccgacaccctgctggccatgggcttcttccgcggcctgcccctggtgcacaccctgatcaccgtgagcaagatcctgcaccacaagatgctgcacagcgtgctgcaggcccccatgagcaccctgaacaccctgaaggccggcggcatcctgaaccgcttcagcaaggacatcgccatcctggacgacctgctgcccctgaccatcttcgacttcatccagctgctgctgatcgtgatcggcgccatcgccgtggtggccgtgctgcagccctacatcttcgtggccaccgtgcccgtgatcgtggccttcatcatgctgcgcgcctacttcctgcagaccagccagcagctgaagcagctggagagcgagggccgcagccccatcttcacccacctggtgaccagcctgaagggcctgtggaccctgcgcgccttcggccgccagccctacttcgagaccctgttccacaaggccctgaacctgcacaccgccaactggttcctgtacctgagcaccctgcgctggttccagatgcgcatcgagatgatcttcgtgatcttcttcatcgccgtgaccttcatcagcatcctgaccaccggcgagggcgagggccgcgtgggcatcatcctgaccctggccatgaacatcatgagcaccctgcagtgggccgtgaacagcagcatcgacgtggacagcctgatgcgcagcgtgagccgcgtgttcaagttcatcgacatgcccaccgagggcaagcccaccaagagcaccaagccctacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagcgcgtgggcctgctgggccgcaccggcagcggcaagagcaccctgctgagcgccttcctgcgcctgctgaacaccgagggcgagatccagatcgacggcgtgagctgggacagcatcaccctgcagcagtggcgcaaggccttcggcgtgatcccccagaaggtgttcatcttcagcggcaccttccgcaagaacctggacccctacgagcagtggagcgaccaggagatctggaaggtggccgacgaggtgggcctgcgcagcgtgatcgagcagttccccggcaagctggacttcgtgctggtggacggcggctgcgtgctgagccacggccacaagcagctgatgtgcctggcccgcagcgtgctgagcaaggccaagatcctgctgctggacgagcccagcgcccacctggaccccgtgacctaccagatcatccgccgcaccctgaagcaggccttcgccgactgcaccgtgatcctgtgcgagcaccgcatcgaggccatgctggagtgccagcagttcctggtgatcgaggagaacaaggtgcgccagtacgacagcatccagaagctgctgaacgagcgcagcctgttccgccaggccatcagccccagcgaccgcgtgaagcttttcccccaccgcaacagcagcaagtgcaagagcaagccccagatcgccgccctgaaggaggagaccgaggaggaggtgcaggacacccgcctgtag

SEQ ID NO: 101 - RNA, 4443 nt, synthetic construct
  misc_feature 1..4443: note = Synthetic construct
  source 1..4443: mol_type = other RNA
atgcagaggtcgcctctggagaaggccagcgtggtgtccaagctgttcttcagctggaccagaccaatcctgaggaagggctacagacagcgcctggagctgtcagacatctaccagatcccttctgtggactctgctgacaacctgtctgagaagctggagagagagtgggacagagagctggccagcaagaagaaccctaagctgatcaacgccctgcggaggtgcttcttctggagattcatgttctacggaatcttcctgtacctgggggaggtgaccaaggccgtgcagcctctgctgctgggaagaatcatcgcctcctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagtatcggacagctggtgagtctgctgtccaacaacctgaacaagttcgacgagggactggccctggcccacttcgtgtggatcgctcctctgcaggtggccctgctgatggggctgatctgggagctgctgcaggcctctgccttctgcggcctgggcttcctgatcgtgctggccctgttccaggccggcctgggcagaatgatgatgaagtacagagaccagagagctggcaagatcagcgagagactggtgatcacctcagagatgatcgagaacatccagtctgtgaaggcatactgctgggaggaggccatggagaagatgatcgagaacctgagacagaccgagctgaagctgacccggaaggccgcctacgtgagatacttcaacagcagcgccttcttcttctcagggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccctgtgctgaaggacatcaacttcaagatcgagagaggacagctgctggccgtggccggatccaccggagccggcaagacctcactgctgatggtgatcatgggagagctggagccttcagagggcaagatcaagcacagtggaagaatctcattctgctctcagttctcctggatcatgcctggcaccatcaaggagaacatcatcttcggtgtgtcctacgacgagtacagatacagaagcgtgatcaaggcctgccagctggaggaggacatctccaagttcgcagagaaggacaacatcgtgctgggagagggtggcatcaccctgagcggaggccagagggccagaatctctctggcaagagcagtgtacaaggacgctgacctgtacctgctggactctcctttcggatacctggacgtgctgaccgagaaggagatcttcgagagctgcgtgtgcaagctgatggccaacaagaccaggatcctggtgacctctaagatggagcacctgaagaaggctgacaagatcctgatcctgcacgagggcagcagctacttctacgggaccttcagcgagctgcagaacctgcagccagacttcagcagcaagctgatgggctgcgactctttcgaccagttcagcgccgagagaagaaacagcatcctgaccgagaccctgcacaggttcagcctggagggcgacgcccctgtgtcctggaccgagaccaagaagcagtctttcaagcagaccggagagttcggcgagaagaggaagaactctatcctgaacccaatcaactctatcaggaagttctccatcgtgcagaagacccccctgcagatgaacggcatcgaggaggactctgacgagcctctggagagaaggctgtccctggtgccagactctgagcagggcgaggccatcctgcctcgcatcagcgtgatcagcaccggccccaccctgcaggccaggaggaggcagtctgtgctgaacctgatgacccacagcgtgaaccagggccagaacatccacaggaagaccaccgcctccaccaggaaggtgagcctggcccctcaggccaacctgaccgagctggacatctacagcagaaggctgtctcaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgcctctctggtggtgctgtggctgctgggcaacacccctctgcaggacaagggcaacagcacccacagcagaaacaacagctacgccgtgatcatcaccagcaccagcagctactacgtgttctacatctacgtgggagtggccgacaccctgctggccatgggcttcttcagaggtctgccactggtgcacaccctgatcaccgtgagcaagatcctgcaccacaagatgctgcactctgtgctgcaggcccctatgagcaccctgaacaccctgaaggccggtgggatcctgaacagattctccaaggacatcgccatcctggacgacctgctgcctctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagtctgagggcaggagtccaatcttcacccacctggtgaccagcctgaagggactgtggaccctgagggccttcggccggcagccttacttcgagaccctgttccacaaggctctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggctgtgaactccagcatcgacgtggacagcctgatgaggtctgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatctccttctcaatcagccctggccagagggtgggcctgctgggaagaaccggctcaggcaagagcaccctgctgagcgccttcctgagactgctgaacaccgagggcgagatccagatcgacggcgtgtcttgggactcaatcaccctgcagcagtggaggaaggccttcggcgtgatcccacagaaggtgttcatcttctctggaaccttcagaaagaacctggacccctacgagcagtggagcgaccaggagatctggaaggtggccgacgaggtgggcctgagatctgtgatcgagcagttccctggcaagctggacttcgtgctggtggacgggggctgcgtgctgagccacggccacaagcagctgatgtgcctggccagatctgtgctgagcaaggccaagatcctgctgctggacgagcccagtgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagcccctccgacagggtgaagctgttcccccaccggaacagcagcaagtgcaagtctaagccccagatcgccgccctgaaggaggagaccgaggaggaggtgcaggacaccaggctgtag

SEQ ID NO: 102 - RNA, 4443 nt, synthetic construct
  misc_feature 1..4443: note = Synthetic construct
  source 1..4443: mol_type = other RNA
atgcagaggtcgcccctggagaaggctagcgtggtgagcaagctgttcttcagctggaccagaccaatcctgaggaagggctacagacagcgcctggagctgtcagacatctaccagatccctagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgctctatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagtatcggacagctggtgagcctgctgagcaacaacctgaacaagttcgacgagggactggccctggcccacttcgtgtggatcgcccctctgcaggtggccctgctgatggggctgatctgggagctgctgcaggccagcgccttctgcggcctgggcttcctgatcgtgctggccctgttccaggccggcctgggcagaatgatgatgaagtacagagaccagagagctggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttctcctggatcatgcccggcaccatcaaggagaacatcatcttcggtgtgagctacgacgagtacagatacagaagcgtgatcaaggcctgccagctggaggaggacatctccaagttcgcagagaaggacaacatcgtgctgggagagggtggcatcaccctgagcggaggccagagggccagaatctctctggcaagagcagtgtacaaggacgccgacctgtacctgctggactctcccttcggatacctggacgtgctgaccgagaaggagatcttcgagagctgcgtgtgcaagctgatggccaacaagaccaggatcctggtgacctctaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagagcttcaagcagaccggagagttcggcgagaagaggaagaacagcatcctgaacccaatcaacagcatcaggaagttctccatcgtgcagaagaccccactgcagatgaacggcatcgaggaggacagcgacgagcccctggagagaaggctgagcctggtgccagactctgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggtgggatcctgaacagattctccaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagtctgagggcaggagtccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatcagcatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggcagcggcaagagcaccctgctgagcgccttcctgagactgctgaacaccgagggcgagatccagatcgacggcgtgagctgggactcaatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagatctgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagagcaagccccagatcgccgccctgaaggaggagaccgaggaggaggtgcaggacaccaggctgtag

SEQ ID NO: 103 - RNA, 4443 nt, synthetic construct
  misc_feature 1..4443: note = Synthetic construct
  source 1..4443: mol_type = other RNA
atgcagaggtcgcccctggagaaggctagcgtggtgtccaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcctctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgtcaagcagggtgctggacaagatcagcatcggacagctggtgagtctgctgagcaacaacctgaacaagttcgacgagggactggccctggcccacttcgtgtggatcgctccactgcaggtggccctgctgatggggctgatctgggagctgctgcaggccagcgccttctgcggcctgggcttcctgatcgtgctggccctgttccaggccggcctgggcagaatgatgatgaagtacagagaccagagagctggcaagatcagcgagagactggtgatcacctcagagatgatcgagaacatccagtctgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgactctctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccccgtgctgaaggacatcaacttcaagatcgagagaggacagctgctggccgtggccggatccaccggagccggcaagaccagcctgctgatggtgatcatgggagagctggagccctcagagggcaagatcaagcacagtggaagaatctcattctgcagccagttctcctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagtctttcaagcagaccggagagttcggcgagaagaggaagaacagcatcctgaacccaatcaacagcatcaggaagttcagcatcgtgcagaagaccccactgcagatgaacggcatcgaggaggacagcgacgagcctctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggcccctcaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccctatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagtccaatcttcacccacctggtgaccagcctgaagggactgtggaccctgagggccttcggccggcagccttacttcgagaccctgttccacaaggccctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggccgtgaacagcagcatcgacgtggacagcctgatgaggagcgtgagcagggtgttcaagttcatcgacatgccaaccgagggcaagcccaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttcagcatcagccccggccagagggtgggcctgctgggaagaaccggctcaggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccccggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagcccctccgacagggtgaagctgttcccccaccggaacagcagcaagtgcaagagcaagccccagatcgccgccctgaaggaggagaccgaggaggaggtgcaggacaccaggctgtag

SEQ ID NO: 104 - RNA, 4443 nt, synthetic construct
  misc_feature 1..4443: note = Synthetic construct
  source 1..4443: mol_type = other RNA
atgcagaggtcgcccctggagaaggctagcgtggtgagcaagctgttcttcagctggaccagaccaatcctgaggaagggctacagacagcgcctggagctgagcgacatctaccagatccctagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcctctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagtatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcacctcagagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgtctgtgctgccctacgccctgatcaagggcatcatcctgcggaagatcttcaccaccatctcattctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagacctctaacggcgacgacagcctgttcttcagcaacttcagcctgctgggcacccctgtgctgaaggacatcaacttcaagatcgagagaggacagctgctggccgtggccggaagcaccggagccggcaagaccagcctgctgatggtgatcatgggagagctggagccctcagagggcaagatcaagcacagcggaagaatcagcttctgcagccagttcagctggatcatgcccggcaccatcaaggagaacatcatcttcggtgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatctctctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgtcctggaccgagaccaagaagcagagcttcaagcagaccggagagttcggcgagaagaggaagaacagcatcctgaacccaatcaactctatcaggaagttcagcatcgtgcagaagaccccactgcagatgaacggcatcgaggaggacagcgacgagcccctggagagaaggctgtccctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgcctctctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccctatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggctctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggctgtgaacagcagcatcgacgtggacagcctgatgaggagcgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatcagcttctcaatcagccctggccagagggtgggcctgctgggaagaaccggcagcggcaagagcaccctgctgagcgccttcctgagactgctgaacaccgagggcgagatccagatcgacggcgtgagctgggacagcatcaccctgcagcagtggaggaaggccttcggcgtgatcccacagaaggtgttcatcttcagcggaaccttcagaaagaacctggacccctacgagcagtggagcgaccaggagatctggaaggtggccgacgaggtgggcctgagaagcgtgatcgagcagttccctggcaagctggacttcgtgctggtggacgggggctgcgtgctgagccacggccacaagcagctgatgtgcctggccagaagcgtgctgagcaaggccaagatcctgctgctggacgagcccagcgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgacagcatccagaagctgctgaacgagaggagcctgttccggcaggccatcagccccagcgacagggtgaagctgttcccccaccggaacagcagcaagtgcaagtctaagccccagatcgccgccctgaaggaggagaccgaggaggaggtgcaggacaccaggctgtag

SEQ ID NO: 105 - RNA, 4443 nt, synthetic construct
  misc_feature 1..4443: note = Synthetic construct
  source 1..4443: mol_type = other RNA
atgcagaggagccccctggagaaggctagcgtggtgagcaagctgttcttcagctggaccagaccaatcctgaggaagggctacagacagcgcctggagctgagcgacatctaccagatccccagcgtggacagcgccgacaacctgagcgagaagctggagagagagtgggacagagagctggccagcaagaagaaccccaagctgatcaacgccctgcggaggtgcttcttctggagattcatgttctacggaatcttcctgtacctgggggaggtgaccaaggccgtgcagcccctgctgctgggaagaatcatcgccagctacgaccccgacaacaaggaggagcgcagcatcgccatctacctgggcatcggcctgtgcctgctgttcatcgtgaggaccctgctgctgcacccagccatcttcggcctgcaccacatcggaatgcagatgagaatcgccatgttcagcctgatctacaagaagaccctgaagctgagcagcagggtgctggacaagatcagcatcggacagctggtgagcctgctgagcaacaacctgaacaagttcgacgagggactggccctggcccacttcgtgtggatcgccccactgcaggtggccctgctgatggggctgatctgggagctgctgcaggccagcgccttctgcggcctgggcttcctgatcgtgctggccctgttccaggccggcctgggcagaatgatgatgaagtacagagaccagagagccggcaagatcagcgagagactggtgatcaccagcgagatgatcgagaacatccagagcgtgaaggcatactgctgggaggaggccatggagaagatgatcgagaacctgagacagaccgagctgaagctgacccggaaggccgcctacgtgagatacttcaacagcagcgccttcttcttcagcgggttcttcgtggtgttcctgagcgtgctgccctacgccctgatcaagggcatcatcctgcggaagatcttcaccaccatcagcttctgcatcgtgctgcgcatggccgtgacccggcagttcccctgggccgtgcagacctggtacgacagcctgggagccatcaacaagatccaggacttcctgcagaagcaggagtacaagaccctggagtacaacctgaccaccaccgaggtggtgatggagaacgtgaccgccttctgggaggagggattcggcgagctgttcgagaaggccaagcagaacaacaacaacagaaagaccagcaacggcgacgacagcctgttcttcagcaacttcagcctgctgggcacccccgtgctgaaggacatcaacttcaagatcgagagaggacagctgctggccgtggccggaagcaccggagccggcaagaccagcctgctgatggtgatcatgggagagctggagcccagcgagggcaagatcaagcacagcggaagaatcagcttctgcagccagttcagctggatcatgcccggcaccatcaaggagaacatcatcttcggcgtgagctacgacgagtacagatacagaagcgtgatcaaggcctgccagctggaggaggacatcagcaagttcgcagagaaggacaacatcgtgctgggagagggcggcatcaccctgagcggaggccagagggccagaatcagcctggcaagagcagtgtacaaggacgccgacctgtacctgctggacagccccttcggatacctggacgtgctgaccgagaaggagatcttcgagagctgcgtgtgcaagctgatggccaacaagaccaggatcctggtgaccagcaagatggagcacctgaagaaggccgacaagatcctgatcctgcacgagggcagcagctacttctacgggaccttcagcgagctgcagaacctgcagccagacttcagcagcaagctgatgggctgcgacagcttcgaccagttcagcgccgagagaagaaacagcatcctgaccgagaccctgcacaggttcagcctggagggcgacgcccccgtgagctggaccgagaccaagaagcagagcttcaagcagaccggagagttcggcgagaagaggaagaacagcatcctgaacccaatcaacagcatcaggaagttcagcatcgtgcagaagaccccactgcagatgaacggcatcgaggaggacagcgacgagcccctggagagaaggctgagcctggtgccagacagcgagcagggcgaggccatcctgccccgcatcagcgtgatcagcaccggccccaccctgcaggccaggaggaggcagagcgtgctgaacctgatgacccacagcgtgaaccagggccagaacatccacaggaagaccaccgccagcaccaggaaggtgagcctggccccacaggccaacctgaccgagctggacatctacagcagaaggctgagccaggagaccggcctggagatcagcgaggagatcaacgaggaggacctgaaggagtgcttcttcgacgacatggagagcatcccagccgtgaccacctggaacacctacctgaggtacatcaccgtgcacaagagcctgatcttcgtgctgatctggtgcctggtgatcttcctggccgaggtggccgccagcctggtggtgctgtggctgctgggcaacaccccactgcaggacaagggcaacagcacccacagcagaaacaacagctacgccgtgatcatcaccagcaccagcagctactacgtgttctacatctacgtgggagtggccgacaccctgctggccatgggcttcttcagaggcctgccactggtgcacaccctgatcaccgtgagcaagatcctgcaccacaagatgctgcacagcgtgctgcaggcccccatgagcaccctgaacaccctgaaggccggcgggatcctgaacagattcagcaaggacatcgccatcctggacgacctgctgcccctgaccatcttcgacttcatccagctgctgctgatcgtgatcggagccatcgccgtggtggccgtgctgcagccctacatcttcgtggccaccgtgccagtgatcgtggccttcatcatgctgagagcctacttcctgcagaccagccagcagctgaagcagctggagagcgagggcaggagcccaatcttcacccacctggtgaccagcctgaagggactgtggaccctgagggccttcggccggcagccctacttcgagaccctgttccacaaggccctgaacctgcacaccgccaactggttcctgtacctgagcaccctgcgctggttccagatgagaatcgagatgatcttcgtgatcttcttcatcgccgtgaccttcatctccatcctgaccaccggcgagggagagggaagagtgggcatcatcctgaccctggccatgaacatcatgagcaccctgcagtgggctgtgaactccagcatcgacgtggacagcctgatgaggtctgtgagcagggtgttcaagttcatcgacatgccaaccgagggcaagcctaccaagagcaccaagccatacaagaacggccagctgagcaaggtgatgatcatcgagaacagccacgtgaagaaggacgacatctggcccagcggcggccagatgaccgtgaaggacctgaccgccaagtacaccgagggcggcaacgccatcctggagaacatctccttctcaatcagccctggccagagggtgggcctgctgggaagaaccggcagcggcaagagcaccctgctgagcgccttcctgagactgctgaacaccgagggcgagatccagatcgacggcgtgtcttgggactcaatcaccctgcagcagtggaggaaggccttcggcgtgatcccacagaaggtgttcatcttctctggaaccttcagaaagaacctggacccctacgagcagtggagcgaccaggagatctggaaggtggccgacgaggtgggcctgagatctgtgatcgagcagttccctggcaagctggacttcgtgctggtggacgggggctgcgtgctgagccacggccacaagcagctgatgtgcctggccagatctgtgctgagcaaggccaagatcctgctgctggacgagcccagtgcccacctggacccagtgacctaccagatcatcagaagaaccctgaagcaggccttcgccgactgcaccgtgatcctgtgcgagcacaggatcgaggccatgctggagtgccagcagttcctggtgatcgaggagaacaaggtgcggcagtacgactccatccagaagctgctgaacgagaggagcctgttccggcaggccatcagcccctccgacagggtgaagctgttcccccaccggaacagcagcaagtgcaagtctaagccccagatcgccgccctgaaggaggagaccgaggaggaggtgcaggacaccaggctgtag

SEQ ID NO: 106 - RNA, 129 nt, synthetic construct
  misc_feature 1..129: note = Untranslated region sequence of TEV
  source 1..129: mol_type = other RNA
tcaacacaacatatacaaaacaaacgaatctcaagcaatcaagcattctacttctattgcagcaatttaaatcatttcttttaaagcaaaagcaattttctgaaaattttcaccatttacgaacgatag

SEQ ID NO: 107 - RNA, 28 nt, synthetic construct
  misc_feature 1..28: note = Untranslated region sequence of AT1G58420
  source 1..28: mol_type = other RNA
attattacatcaaaacaaaaagccgcca

SEQ ID NO: 108 - RNA, 116 nt, synthetic construct
  misc_feature 1..116: note = Untranslated region sequence of human IL-6
  source 1..116: mol_type = other RNA
aatattagagtctcaacccccaataaatataggactggagatgtctgaggctcattctgccctcgagcccaccgggaacgaaagagaagctctatctcccctccaggagcccagct

SEQ ID NO: 109 - RNA, 46 nt, synthetic construct
  misc_feature 1..46: note = Untranslated region sequence of mouse albumin
  source 1..46: mol_type = other RNA
tgcacacagatcacctttcctatcaaccccactagcctctggcaaa

SEQ ID NO: 110 - RNA, 50 nt, synthetic construct
  misc_feature 1..50: note = Untranslated region sequence of mouse beta-globin
  source 1..50: mol_type = other RNA
acatttgcttctgacacaactgtgttcactagcaacctcaaacagacacc

SEQ ID NO: 111 - RNA, 132 nt, synthetic construct
  misc_feature 1..132: note = Untranslated region sequence of human CFTR
  source 1..132: mol_type = other RNA
aattggaagcaaatgacatcacagcaggtcagagaaaaagggttgagcggcaggcacccagagtagtaggtctttggcattaggagcttgagcccagacggccctagcagggaccccagcgcccgagagacc

SEQ ID NO: 112 - RNA, 44 nt, synthetic construct
  misc_feature 1..44: note = Untranslated region sequence of respiratory syncytial virus (RSV)
  source 1..44: mol_type = other RNA
acgcgaaaaaatgcgtacaacaaacttgcgtaaaccaaaaaaat

SEQ ID NO: 113 - RNA, 82 nt, synthetic construct
  misc_feature 1..82: note = Untranslated region sequence of human surfactant-A1
  source 1..82: mol_type = other RNA
gacttggaggcagagacccaagcagctggaggctctgtgtgtggcctggagaccccacaacctccagccggaggcctgaagc

SEQ ID NO: 114 - RNA, 97 nt, synthetic construct
  misc_feature 1..97: note = Untranslated region sequence of human surfactant protein A2
  source 1..97: mol_type = other RNA
aacttggaggcagagacccaagcagctggaggctctgtgtgtgggtcgctgatttcttggagcctgaaaagaaggagcagcgactggacccagagcc

SEQ ID NO: 115 - RNA, 53 nt, synthetic construct
  misc_feature 1..53: note = Untranslated region sequence of human napsin A asparatic peptidase (NAPSA)
  source 1..53: mol_type = other RNA
gggaaagaaaatgaggccccaggacacctgggttcacacccaggtccccagcg

SEQ ID NO: 116 - RNA, 108 nt, synthetic construct
  misc_feature 1..108: note = Untranslated region sequence of human carboxylesterase 1 (CES1)
  source 1..108: mol_type = other RNA
agcgcagggcggtaactctgggcggggctgggctccagggctggacagcacagtccctctgaactgcacagagacctcgcaggccccgagaactgtcgcccttccacg

SEQ ID NO: 117 - RNA, 149 nt, synthetic construct
  misc_feature 1..149: note = Untranslated region sequence of human CEACAM6
  source 1..149: mol_type = other RNA
gaccctgggaaatgcttctatccctgagaggaggctcagcacagaaggaggaaggacagcagggccaacagtcacagcagccctgaccagagcattcctggagctcaagctcctctacaaagaggtggacagagaagacagcagagacc

SEQ ID NO: 118 - RNA, 62 nt, synthetic construct
  misc_feature 1..62: note = Untranslated region sequence of human growth hormone
  source 1..62: mol_type = other RNA
aggatcccaaggcccaactccccgaaccactcagggtcctgtggacagctcacctagctgca

SEQ ID NO: 119 - RNA, 29 nt, synthetic construct
  misc_feature 1..29: note = Untranslated region sequence of influenza A/HA
  source 1..29: mol_type = other RNA
agcaaaagcaggggataattctattaacc

SEQ ID NO: 120 - RNA, 26 nt, synthetic construct
  misc_feature 1..26: note = Untranslated region sequence of influenza A/NS1
  source 1..26: mol_type = other RNA
agcaaaagcagggtgacaaagacata

SEQ ID NO: 121 - RNA, 25 nt, synthetic construct
  misc_feature 1..25: note = Untranslated region sequence of influenza A/M1
  source 1..25: mol_type = other RNA
agcaaaagcaggtagatattgaaag

SEQ ID NO: 122 - RNA, 45 nt, synthetic construct
  misc_feature 1..45: note = Untranslated region sequence of influenza A/NP
  source 1..45: mol_type = other RNA
agcaaaagcagggttaataatcactcaccgagtgacatcaaaatc

SEQ ID NO: 123 - RNA, 245 nt, synthetic construct
  misc_feature 1..245: note = Untranslated region sequence of HHV
  source 1..245: mol_type = other RNA
cagatcgcctggagacgccatccacgctgttttgacctccatagaagacaccgggaccgatccagcctccgcggccgggaacggtgcattggaacgcggattccccgtcagatcgcctggagacgccatccacgctgttttgacctccatagaagacaccgggaccgatccagcctccgcggccgggaacggtgcattggaacgcggattccccgtgccaagagtgactcaccgtccttgacacg

SEQ ID NO: 124 - RNA, 155 nt, synthetic construct
  misc_feature 1..155: note = Untranslated region sequence of human HSP27 (HSPB1)
  source 1..155: mol_type = other RNA
gcatggggaggggcggccctcaaacgggtcattgccattaatagagacctcaaacaccgcctgctaaaaatacccgactggaggagcataaaagcgcagccgagcccagcgccccgcacttttctgagcagacgtccagagcagagtcagccagc

SEQ ID NO: 125 - RNA, 135 nt, synthetic construct
  misc_feature 1..135: note = Untranslated region sequence of human HSP70
  source 1..135: mol_type = other RNA
ccttctggaaggttctaagatagggtataagaggcagggtggcgggcggaaaccggtctcattgaactcgcctgcagctcttgggttttttgtggcttccttcgttattggagccaggcctacaccccagcaacc

SEQ ID NO: 126 - RNA, 158 nt, synthetic construct
  misc_feature 1..158: note = Untranslated region sequence of XBG
  source 1..158: mol_type = other RNA
ctagtgactgactaggatctggttaccactaaaccagcctcaagaacacccgaatggagtctctaagctacataataccaacttacacttacaaaatgttgtcccccaaaatgtagccattcgtatctgctcctaataaaaagaaagtttcttcacat

SEQ ID NO: 127 - RNA, 170 nt, synthetic construct
  misc_feature 1..170: note = Untranslated region sequence of mouse albumin
  source 1..170: mol_type = other RNA
acacatcacaaccacaaccttctcaggctaccctgagaaaaaaagacatgaagactcaggactcatcttttctgttggtgtaaaatcaacaccctaaggaacacaaatttctttaaacatttgacttcttgtctctgtgctgcaattaataaaaaatggaaagaatctac

SEQ ID NO: 128 - RNA, 171 nt, synthetic construct
  misc_feature 1..171: note = Untranslated region sequence of alanine aminotransferase 1
  source 1..171: mol_type = other RNA
gcaccccagctggggccaggctgggtcgccctggactgtgtgctcaggagccctgggaggctctggagcccactgtacttgctcttgatgcctggcggggtggggtggggggggtgctgggcccctgcctctctgcaggtccctaataaagctgtgtggcagtctgactcc

SEQ ID NO: 129 - RNA, 106 nt, synthetic construct
  misc_feature 1..106: note = Untranslated region sequence of human growth factor
  source 1..106: mol_type = other RNA
tggcatccctgtgacccctccccagtgcctctcctggccctggaagttgccactccagtgcccaccagccttgtcctaataaaattaagttgcatcattttgtctg

SEQ ID NO: 130 - RNA, 143 nt, synthetic construct
  misc_feature 1..143: note = Untranslated region sequence of human apolipoprotein E
  source 1..143: mol_type = other RNA
acgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgca

SEQ ID NO: 131 - RNA, 160 nt, synthetic construct
  misc_feature 1..160: note = Untranslated region sequence of MALAT
  source 1..160: mol_type = other RNA
gattcgtcagtagggttgtaaaggtttttcttttcctgagaaaacaaccttttgttttctcaggttttgctttttggcctttccctagctttaaaaaaaaaaaagcaaaagacgctggtggctggcactcctggtttccaggacggggttcaagtccctg

SEQ ID NO: 132 - RNA, 1556 nt, synthetic construct
  misc_feature 1..1556: note = Untranslated region sequence of human CFTR
  source 1..1556: mol_type = other RNA
agagcagcataaatgttgacatgggacatttgctcatggaattggagctcgtgggacagtcacctcatggaattggagctcgtggaacagttacctctgcctcagaaaacaaggatgaattaagtttttttttaaaaaagaaacatttggtaaggggaattgaggacactgatatgggtcttgataaatggcttcctggcaatagtcaaattgtgtgaaaggtacttcaaatccttgaagatttaccacttgtgttttgcaagccagattttcctgaaaacccttgccatgtgctagtaattggaaaggcagctctaaatgtcaatcagcctagttgatcagcttattgtctagtgaaactcgttaatttgtagtgttggagaagaactgaaatcatacttcttagggttatgattaagtaatgataactggaaacttcagcggtttatataagcttgtattcctttttctctcctctccccatgatgtttagaaacacaactatattgtttgctaagcattccaactatctcatttccaagcaagtattagaataccacaggaaccacaagactgcacatcaaaatatgccccattcaacatctagtgagcagtcaggaaagagaacttccagatcctggaaatcagggttagtattgtccaggtctaccaaaaatctcaatatttcagataatcacaatacatcccttacctgggaaagggctgttataatctttcacaggggacaggatggttcccttgatgaagaagttgatatgccttttcccaactccagaaagtgacaagctcacagacctttgaactagagtttagctggaaaagtatgttagtgcaaattgtcacaggacagcccttctttccacagaagctccaggtagagggtgtgtaagtagataggccatgggcactgtgggtagacacacatgaagtccaagcatttagatgtataggttgatggtggtatgttttcaggctagatgtatgtacttcatgctgtctacactaagagagaatgagagacacactgaagaagcaccaatcatgaattagttttatatgcttctgttttataattttgtgaagcaaaattttttctctaggaaatatttattttaataatgtttcaaacatatataacaatgctgtattttaaaagaatgattatgaattacatttgtataaaataatttttatatttgaaatattgactttttatggcactagtatttctatgaaatattatgttaaaactgggacaggggagaacctagggtgatattaaccaggggccatgaatcaccttttggtctggagggaagccttggggctgatgcagttgttgcccacagctgtatgattcccagccagcacagcctcttagatgcagttctgaagaagatggtaccaccagtctgactgtttccatcaagggtacactgccttctcaactccaaactgactcttaagaagactgcattatatttattactgtaagaaaatatcacttgtcaataaaatccatacatttgtgtgaa

SEQ ID NO: 133 - RNA, 226 nt, synthetic construct
  misc_feature 1..226: note = Untranslated region sequence of respiratory syncytial virus (RSV)
  source 1..226: mol_type = other RNA
tgaataaaaatcttatattaaaaattcccatagctacacactaacactgtattcaattatagttatttaaaattaaaaattatataattttttaataacttttagtgaactaatcctaaaattatcattttgatctaggaggaataaatttaaatccaaatctaattggtttatatgtatattaactaaactacgagatattagtttttgacactttttttctcgt

SEQ ID NO: 134 - RNA, 1330 nt, synthetic construct
  misc_feature 1..1330: note = Untranslated region sequence of human surfactant-A1
  source 1..1330: mol_type = other RNA
gaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactctcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctctctctgcaacccagtgccatcaggatgagcaatcctggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacaccaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcaca

SEQ ID NO: 135 - RNA, 1357 nt, synthetic construct
  misc_feature 1..1357: note = Untranslated region sequence of human surfactant protein A2
  source 1..1357: mol_type = other RNA
gaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataataaatcgttagtgtgttcacatgagtttccata

SEQ ID NO: 136 - RNA, 76 nt, synthetic construct
  misc_feature 1..76: note = Untranslated region sequence of human napsin A asparatic peptidase (NAPSA)
  source 1..76: mol_type = other RNA
cgcccaagtgaagcgcatgcgcagcgggtggtcgcggaggtcctgctacccagtaaaaatccactatttccattga

SEQ ID NO: 137 - RNA, 197 nt, synthetic construct
  misc_feature 1..197: note = Untranslated region sequence of human carboxylesterase 1
  source 1..197: mol_type = other RNA
atgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggccaa

SEQ ID NO: 138 - RNA, 1447 nt, synthetic construct
  misc_feature 1..1447: note = Untranslated region sequence of human CEACAM6
  source 1..1447: mol_type = other RNA
cagccctggtgtattttcgatatttcaggaagactggcagattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacaggcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtatcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtagaaattaacaaatgtgctgcttggttaaaatggctacactcatctgactcattctttattctattttagttggtttgtatcttgcctaaggtgcgtagtccaactcttggtattaccctcctaatagtcatactagtagtcatactccctggtgtagtgtattctctaaaagctttaaatgtctgcatgcagccagccatcaaatagtgaatggtctctctttggctggaattacaaaactcagagaaatgtgtcatcaggagaacatcataacccatgaaggataaaagccccaaatggtggtaactgataatagcactaatgctttaagatttggtcacactctcacctaggtgagcgcattgagccagtggtgctaaatgctacatactccaactgaaatgttaaggaagaagatagatccaattaaaaaaaattaaaaccaatttaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataact

SEQ ID NO: 139 - RNA, 106 nt, synthetic construct
  misc_feature 1..106: note = Untranslated region sequence of human growth hormone
  source 1..106: mol_type = other RNA
ctgcccgggtggcatccctgtgacccctccccagtgcctctcctggccctggaagttgccactccagtgcccaccagccttgtcctaataaaattaagttgcatca

SEQ ID NO: 140 - RNA, 32 nt, synthetic construct
  misc_feature 1..32: note = Untranslated region sequence of influenza A/HA
  source 1..32: mol_type = other RNA
gtgcattaattaaaaacacccttgtttctact

SEQ ID NO: 141 - RNA, 171 nt, synthetic construct
  misc_feature 1..171: note = Untranslated region sequence of influenza A/NS1
  source 1..171: mol_type = other RNA
agagataagatggctgattgaagaagtgagacacagactaaaaacaactgaaaatagctttgaacaaataacattcatgcaagcattacaactgctgtttgaagtggaacaggagataagaactttctcatttcagcttatttaatgataaaaaacacccttgtttctact

SEQ ID NO: 142 - RNA, 243 nt, synthetic construct
  misc_feature 1..243: note = Untranslated region sequence of influenza A/M1
  source 1..243: mol_type = other RNA
cccgcttgttgttgccgcgagtatcattgggatcttgcacttgatattgtggattcttgatcgtctttttttcaaatgcgtctatcgactcttcaaacacggccttaaaagaggcccttctacggaaggagtacctgagtctatgagggaagaatatcgaaaggaacagcagaatgctgtggatgctgacgacagtcattttgtcagcatagagttggagtaaaaaactaccttgtttctact

SEQ ID NO: 143 - RNA, 24 nt, synthetic construct
  misc_feature 1..24: note = Untranslated region sequence of influenza A/NP
  source 1..24: mol_type = other RNA
ggaaaaaatacccttgtttctact

SEQ ID NO: 144 - RNA, 124 nt, synthetic construct
  misc_feature 1..124: note = Untranslated region sequence of human HSP27 (HSPB1)
  source 1..124: mol_type = other RNA
agccttagcccggatgcccacccctgctgccgccactggctgtgcctcccccgccacctgtgtgttcttttgatacatttatcttctgtttttctcaaataaagttcaaagcaaccacctgtca

SEQ ID NO: 145 - RNA, 242 nt, synthetic construct
  misc_feature 1..242: note = Untranslated region sequence of human HSP70
  source 1..242: mol_type = other RNA
gccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccata

SEQ ID NO: 146 - RNA, 4443 nt, synthetic construct
  misc_feature 1..4443: note = Synthetic construct
  source 1..4443: mol_type = other RNA
atgcagcggtccccgctcgaaaaggccagtgtcgtgtccaaactcttcttctcatggactcggcctatccttagaaaggggtatcggcagaggcttgagttgtctgacatctaccagatcccctcggtagattcggcggataacctctcggagaagctcgaacgggaatgggaccgcgaactcgcgtctaagaaaaacccgaagctcatcaacgcactgagaaggtgcttcttctggcggttcatgttctacggtatcttcttgtatctcggggaggtcacaaaagcagtccaacccctgttgttgggtcgcattatcgcctcgtacgaccccgataacaaagaagaacggagcatcgcgatctacctcgggatcggactgtgtttgcttttcatcgtcagaacacttttgttgcatccagcaatcttcggcctccatcacatcggtatgcagatgcgaatcgctatgtttagcttgatctacaaaaagacactgaaactctcgtcgcgggtgttggataagatttccatcggtcagttggtgtccctgcttagtaataacctcaacaaattcgatgagggactggcgctggcacatttcgtgtggattgccccgttgcaagtcgcccttttgatgggccttatttgggagctgttgcaggcatctgccttttgtggcctgggatttctgattgtgttggcattgtttcaggctgggcttgggcggatgatgatgaagtatcgcgaccagagagcgggtaaaatctcggaaagactcgtcatcacttcggaaatgatcgaaaacatccagtcggtcaaagcctattgctgggaagaagctatggagaagatgattgaaaacctccgccaaactgagctgaaactgacccgcaaggcggcgtatgtccggtatttcaattcgtcagcgttcttcttttccgggttcttcgttgtctttctctcggttttgccttatgccttgattaaggggattatcctccgcaagattttcaccacgatttcgttctgcattgtattgcgcatggcagtgacacggcaatttccgtgggccgtgcagacatggtatgactcgcttggagcgatcaacaaaatccaagacttcttgcaaaagcaagagtacaagaccctggagtacaatcttactactacggaggtagtaatggagaatgtgacggctttttgggaagagggttttggagaactgtttgagaaagcaaagcagaataacaacaaccgcaagacctcaaatggggacgattccctgtttttctcgaacttctccctgctcggaacacccgtgttgaaggacatcaatttcaagattgagaggggacagcttctcgcggtagcgggaagcactggtgcgggaaaaactagcctcttgatggtgattatgggggagcttgagcccagcgaggggaagattaaacactccgggcgtatctcattctgtagccagttttcatggatcatgcccggaaccattaaagagaacatcattttcggagtatcctatgatgagtaccgatacagatcggtcattaaggcgtgccagttggaagaggacatttctaagttcgccgagaaggataacatcgtcttgggagaagggggtattacattgtcgggagggcagcgagcgcggatcagcctcgcgagagcggtatacaaagatgcagatttgtatctgcttgattcaccgtttggatacctcgacgtattgacagaaaaagaaatcttcgagtcgtgcgtgtgtaaacttatggctaataagacgagaatcctggtgacatcaaaaatggaacaccttaagaaggcggacaagatcctgatcctccacgaaggatcgtcctacttttacggcactttctcagagttgcaaaacttgcagccggacttctcaagcaaactcatggggtgtgactcattcgaccagttcagcgcggaacggcggaactcgatcttgacggaaacgctgcaccgattctcgcttgagggtgatgccccggtatcgtggaccgagacaaagaagcagtcgtttaagcagacaggagaatttggtgagaaaagaaagaacagtatcttgaatcctattaactcaattcgcaagttctcaatcgtccagaaaactccactgcagatgaatggaattgaagaggattcggacgaacccctggagcgcaggcttagcctcgtgccggattcagagcaaggggaggccattcttccccggatttcggtgatttcaaccggacctacacttcaggcgaggcgaaggcaatccgtgctcaacctcatgacgcattcggtaaaccaggggcaaaacattcaccgcaaaacgacggcctcaacgagaaaagtgtcacttgcaccccaggcgaatttgactgaactcgacatctacagccgtaggctttcgcaagaaaccggacttgagatcagcgaagaaatcaatgaagaagatttgaaagagtgtttctttgatgacatggaatcaatcccagcggtgacaacgtggaacacatacttgcgttacatcacggtgcacaagtccttgattttcgtcctcatctggtgtctcgtgatctttctcgctgaggtcgcagcgtcacttgtggtcctctggctgcttggtaatacgcccttgcaagacaaaggcaattctacacactcaagaaacaattcctatgccgtgattatcacttctacaagctcgtattacgtgttttacatctacgtaggagtggccgacactctgctcgcgatgggtttcttccgaggactcccactcgttcacacgcttatcactgtctccaagattctccaccataagatgcttcatagcgtactgcaggctcccatgtccaccttgaatacgctcaaggcgggaggtattttgaatcgcttctcaaaagatattgcaattttggatgaccttctgcccctgacgatcttcgacttcatccagttgttgctgatcgtgattggggctattgcagtagtcgctgtcctccagccttacatttttgtcgcgaccgttccggtgatcgtggcgtttatcatgctgcgggcctatttcttgcagacgtcacagcagcttaagcaactggagtctgaagggaggtcgcctatctttacgcatcttgtgaccagtttgaagggattgtggacgttgcgcgcctttggcaggcagccctactttgaaacactgttccacaaagcgctgaatctccatacggcaaattggtttttgtatttgagtaccctccgatggtttcagatgcgcattgagatgatttttgtgatcttctttatcgcggtgacttttatctccatcttgaccacgggagagggcgagggacgggtcggtattatcctgacactcgccatgaacattatgagcactttgcagtgggcagtgaacagctcgattgatgtggatagcctgatgaggtccgtttcgagggtctttaagttcatcgacatgccgacggagggaaagcccacaaaaagtacgaaaccctataagaatgggcaattgagtaaggtaatgatcatcgagaacagtcacgtgaagaaggatgacatctggcctagcgggggtcagatgaccgtgaaggacctgacggcaaaatacaccgagggagggaacgcaatccttgaaaacatctcgttcagcattagccccggtcagcgtgtggggttgctcgggaggaccgggtcaggaaaatcgacgttgctgtcggccttcttgagacttctgaatacagagggtgagatccagatcgacggcgtttcgtgggatagcatcaccttgcagcagtggcggaaagcgtttggagtaatcccccaaaaggtctttatctttagcggaaccttccgaaagaatctcgatccttatgaacagtggtcagatcaagagatttggaaagtcgcggacgaggttggccttcggagtgtaatcgagcagtttccgggaaaactcgactttgtccttgtagatgggggatgcgtcctgtcgcatgggcacaagcagctcatgtgcctggcgcgatccgtcctctctaaagcgaaaattcttctcttggatgaaccttcggcccatctggacccggtaacgtatcagatcatcagaaggacacttaagcaggcgtttgccgactgcacggtgattctctgtgagcatcgtatcgaggccatgctcgaatgccagcaatttcttgtcatcgaagagaataaggtccgccagtacgactccatccagaagctgcttaatgagagatcattgttccggcaggcgatttcaccatccgatagggtgaaactttttccacacagaaattcgtcgaagtgcaagtccaaaccgcagatcgcggccttgaaagaagagactgaagaagaagttcaagacacgcgtctttaa

---

What is claimed is:

1. A kit for expressing a human Cystic Fibrosis Transmembrane Conductance Regulator (CFTR) protein in vivo, the kit comprising a 0.1 to 500 mg dose of a pharmaceutical composition comprising an mRNA comprising an open reading frame (ORF) having 100% sequence identity with SEQ ID NO:100, at least 94% sequence identity with SEQ ID NO:101, or at least 97% sequence identity with one of SEQ ID NOs: 102-105; and a device for administering the dose.

2. The kit of claim 1, wherein the device is an injection needle, an intravenous needle, or an inhalation device.

3. The kit of claim 2, wherein the device is an inhalation device.

4. The kit of claim 1, wherein the open reading frame has 100% sequence identity with SEQ ID NO: 100.

5. The kit of claim 1, wherein the open reading frame has at least 94% sequence identity with SEQ ID NO: 101.

6. The kit of claim 1, wherein the open reading frame has 97% sequence identity with SEQ ID NO: 105.

7. The kit of claim 1, wherein the ORF has the sequence of SEQ ID NO: 101.

8. The kit of claim 1, wherein the ORF has the sequence of SEQ ID NO: 105.

9. The kit of claim 1, wherein the mRNA further comprises a 5' untranslated region (5' UTR).

10. The kit of claim 9, wherein the 5' UTR comprises a sequence selected from SEQ ID NOs: 106-125.

11. The kit of claim 1, wherein the mRNA further comprises a 3' untranslated region (3' UTR).

12. The kit of claim 11, wherein the 3' UTR comprises a sequence selected from SEQ ID NOs: 126-145.

13. The kit of claim 1, wherein the mRNA further comprises (a) a 3' poly-adenosine (poly-A) tail; or (b) a 5' cap; or (c) both (i) and (ii).

14. The kit of claim 13, wherein the 5' cap is (i) $m^7GpppGm$ having the structure of Formula Cap IV (Cap IV)

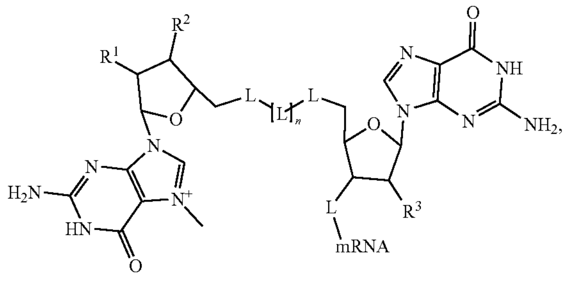

wherein $R^1$ and $R^2$ are each OH, $R^3$ is $OCH_3$, each L is a phosphate linked by diester bonds, mRNA is the mRNA linked at its 5' end, and n is 1; or (ii) $m^7GpppAmpG$ having the structure of Formula Cap V (Cap V)

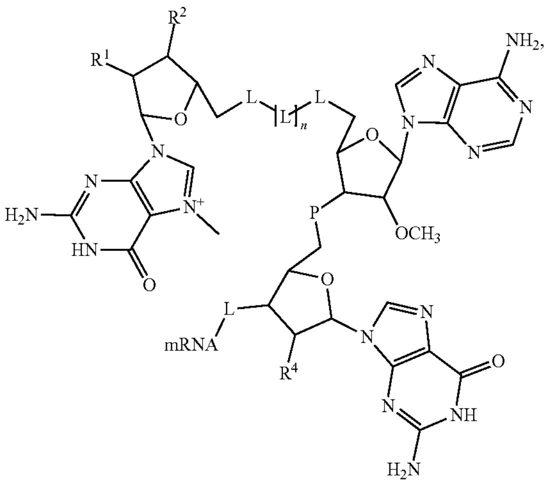

wherein $R^1$, $R^2$, and $R^4$ are each OH, n is 1, each L is a phosphate linked by diester bonds, and mRNA is the mRNA linked at its 5' end.

15. The kit of claim 1, wherein the mRNA comprises one or more chemically-modified nucleotides.

16. The kit of claim 15, wherein wherein the one or more chemically-modified nucleotides are each independently selected from 5-hydroxycytidine, 5-methylcytidine, 5-hydroxymethylcytidine, 5-carboxycytidine, 5-formylcytidine, 5-methoxycytidine, 5-propynylcytidine, 2-thiocytidine, 5-hydroxyuridine, 5-methyluridine, 5,6-dihydro-5-methyluridine, 2'-O-methyluridine, 2'-O-methyl-5-methyluridine, 2'-fluoro-2'-deoxyuridine, 2'-amino-2'-deoxyuridine, 2'-azido-2'-deoxyuridine, 4-thiouridine, 5-hydroxymethyluridine, 5-carboxyuridine, 5-carboxymethylesteruridine, 5-formyluridine, 5-methoxyuridine, 5-propynyluridine, 5-bromouridine, 5-iodouridine, 5-fluorouridine, pseudouridine, 2'-O-methyl-pseudouridine, $N^1$-hydroxypseudouridine, $N^1$-methylpseudouridine, 2'-O-methyl-$N^1$-methylpseudouridine, $N^1$-ethylpseudouridine, $N^1$-hydroxymethylpseudouridine, arauridine, $N^6$-methyladenosine, 2-aminoadenosine, 3-methyladenosine, 7-deazaadenosine, 8-oxoadenosine, inosine, thienoguanosine, 7-deazaguanosine, 8-oxoguanosine, and 6-O-methylguanosine.

17. The kit of claim 1, wherein the mRNA comprises a sequence selected from SEQ ID NOs: 49, 53, 66, 68, 69, and 72.

18. The kit of claim 1, wherein the pharmaceutical composition further comprises a lipid of Formula I (I)

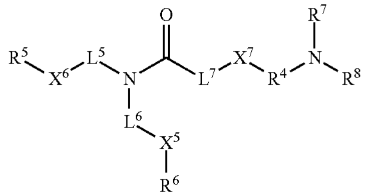

or a pharmaceutically acceptable salt or solvate thereof, wherein $R^5$ and $R^6$ are each independently selected from the group consisting of a linear or branched $C_1$-$C_{31}$ alkyl, $C_2$-$C_{31}$ alkenyl or $C_2$-$C_{31}$ alkynyl and cholesteryl;

$L^5$ and $L^6$ are each independently selected from the group consisting of a linear $C_1$-$C_{20}$ alkyl and $C_2$-$C_{20}$ alkenyl;

$X^5$ is —C(O)O— or —OC(O)—;

$X^6$ is —C(O)O— or —OC(O)—;

$X^7$ is S or O;

$L^7$ is absent or lower alkyl;

$R^4$ is a linear or branched $C_1$-$C_6$ alkyl; and $R^7$ and $R^8$ are each independently selected from the group consisting of a hydrogen and a linear or branched $C_1$-$C_6$ alkyl.

19. The kit of claim 1, wherein the pharmaceutical composition further comprises a lipid selected from

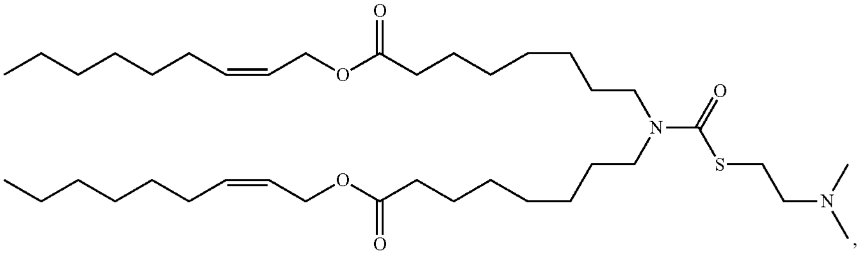

,

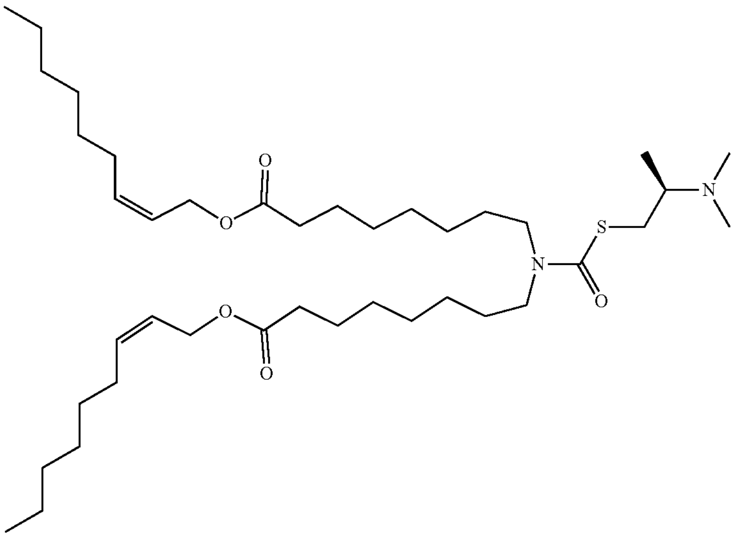

,

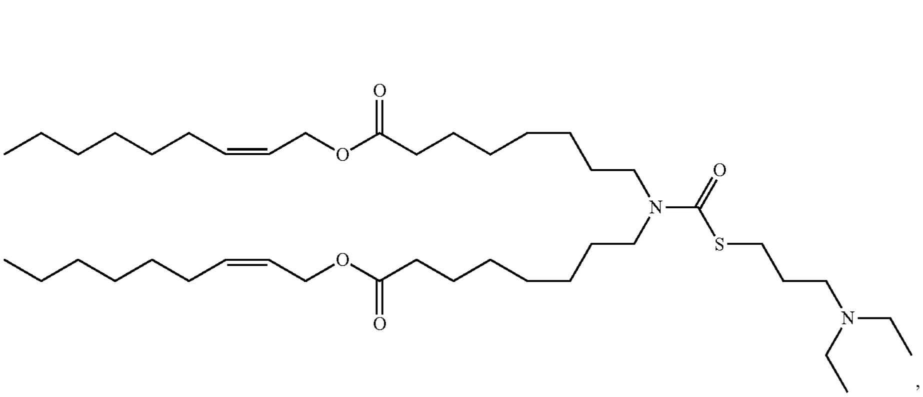

,

-continued

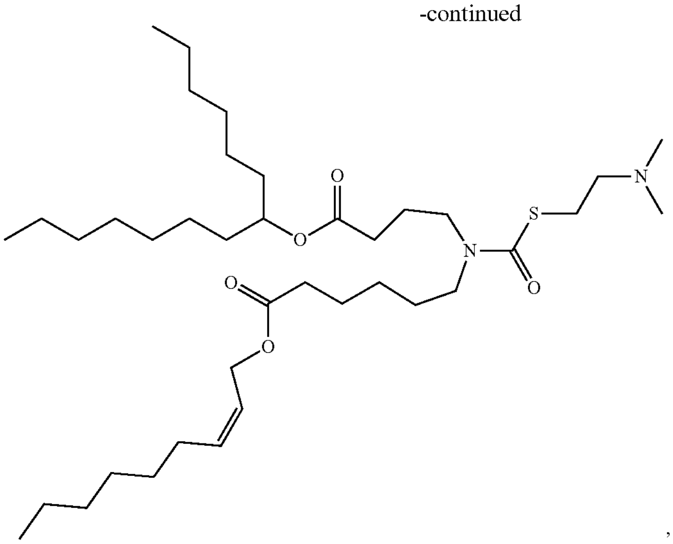

, and

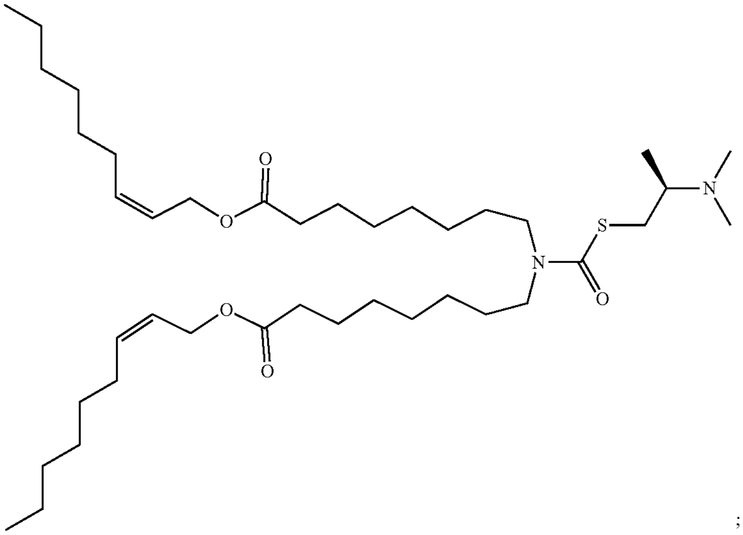

;

or a pharmaceutically acceptable salt or solvate thereof.

20. The kit of claim 19, wherein the pharmaceutical composition comprises lipid nanoparticles comprising:

(A) a helper lipid;

(B) a cholesterol;

(C) a lipid-conjugate; or (D) any combination thereof.

21. The kit of claim 1, wherein the open reading frame has at least 97% sequence identity with one of SEQ ID NOs: 102-104.

22. The kit of claim 1, wherein the ORF has the sequence of one of SEQ ID NOs: 102-104.

* * * * *